United States Patent 9,115,368 (GENES AND USES FOR PLANT IMPROVEMENT) - sequence listing, part 4

SEQ ID NO: 14148 - protein, 749 aa, Aspergillus fumigatus
MATKIAGGLHRAQEVLQNTSSKSKKLVDLERDTADAHTQQPLTTDHGVRVSNTDQWLRVTNDRRTGPSLLEDQIAREKIHRFDHERIPERVVHARGTGAFGNFKLKESIEDLTYAGVLTDTSRNTPVFVRFSTVQGSRGSADTVRDVRGFAVKFYTDEGNWDIVGNNIPVFFIQDAVKFPDFVHAVKPEPHNEVPQAQTAHNNFWDFVYLHPEATHMFMWAMSDRAIPRSYRMMQGFGVNTFALVNKEGKRHFVKFHWIPHLGVHSLVWDEALKLGGQDPDFHRKDLMEAIDNKAYPKWDFAIQVIPEEKQDDFEFDILDATKIWPENLVPLRVIGELELNRNVDEFFPQTEQVAFCTSHIVPGIDFTDDPLLQGRNFSYFDTQISRLGINWEELPINRPVCPVLNHNRDGQMRHRITQGTVNYWPNRFEAVPPTGTKGSGVGGGFTTYPQRVEGIKNRALNDKFREHHNQAQLFYNSMSEHEKLHMKKAFSFELDHCDDPTVYERLAGHRLAEIDLELAQKVAEMVGAPIPAKALKQNHGRRAPHLSQTEFIPKNPTIASRRIAIIIGDGYDPVASTGLKTAIKAASALPFIIGTKRSAIYATEDKTSSKGIIPDHHYDGQRSTMFDATFIPGGPHVATLRQNGQIKYWISETFGHLKALGATGEAVDLVKETLSGTLHVQVASSQSPEPVEWYGVVTAGGKQKPESFKESVQILKGATDFVGKFFYQISQHRNYQRELDGLASTIAF

SEQ ID NO: 14149 - protein, 173 aa, Triticum aestivum
  unsure (1)..(173): unsure at all Xaa locations
DNTDVHHGGFVVTGPRGAHLLIVFGVLVYMQVLSACFMSFDHGGNDVSYSIGPMSAALSVLHGVASIAQIVISSEVLARGGLGIVAGLTMWGYRVIATMGKKVQTLSSSRGFAAAXAVASVVLLACKLGLSTFSTHPLVGAVMGVRYPSGLHRVRAETVREIVVSLGGRICSW

SEQ ID NO: 14150 - protein, 286 aa, Triticum aestivum
  unsure (1)..(286): unsure at all Xaa locations
VNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMXRXXEVNYFPSRFDPTRHAEQYPIPPRVLSXXREKCIIEKENNFKQAGERYRSFDPARQDRFLQRWVDALTDARVTHEIQGIWVSYWSQCDTSLGQKLASRLKIKPSM

SEQ ID NO: 14151 - protein, 601 aa, Zea mays
LNSIPAPANATPSALIRSRRRRHSRARPMDSARSWLQKLQPRDKDRERGAKTPAPASPNGGAGNSARMAAAAGEEALSSATKQKVAAAKQYIENHYKSQMKSLQERKERRWMLERKLADADVSEEEQNNILKDLEKKETEYMRLRRHKMGVDDFELLTIIGRGAFGEVRLCREKATSNVYAMKKLKKSEMLRRGQVEHVRAERDLLAEVDSPYIVKLYCSFQDDEFLYLIMEYLPGGDMMTLLMRKDTLTEDESKFYVAETILAIESIHKRIYIHRDIKPDNLLLDRSGHLKLSDFGLCKPLDSSCFPNLSDLDYAAGKSTNPSSDGDKQSSNSTAPRRTQQEQLLHWQKNRRMLAYSTVGTPDYIAPEVLLKKGYGMECDWWSLGAIMFEMLVGYPPFYSEDPMSTCRKIVNWRSHLKFPEEASLSLEAKDLISKLLCNVDQRIGTKGAHEIKAHPWFAGVEWEKLYQMEAAFIPEVNDELDTQNFEKFEETAPPMQTSSKAGPWRKMLSSKDVNFVGYTYKNFEIVNDPELPGIAELKKTNNKPKRPTIKSLFETADSEDQPSDGSFLNLLPTQLELPESLEPSPHSSISSEDSQARNR

SEQ ID NO: 14152 - protein, 498 aa, Zea mays
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGLWGALIEGPRIGRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 14153 - protein, 708 aa, Zea mays
TSKHSADLLMRIQFAKENSIELHLPGIKLGEHEDVTEEAVLTTLKRAISRFSTLQAHDGHWPGDYGGPMFLMPGLIITLYVTGALNTVLSLEHQKEIRRYLYNHQNEDGGWGLHIEGPSTMFGSALTYVILRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSEDGEFPQQEIIGVFNKNCMISYSQYRNIFPIWALGEYRCRVLGAGKPWR

SEQ ID NO: 14154 - protein, 1021 aa, Daucus carota
MGVLRVYVILILVGFCVQIVVVNSQNLTCNSNDLKALEGFMRGLESSIDGWKWNESSSFSSNCCDWVGISCKSSVSLGLDDVNESGRVVELELGRRKLSGKLSESVAKLDQLKVLNLTHNSLSGSIAASLLNLSNLEVLDLSSNDFSGLFPSLINLPSLRVLNVYENSFHGLIPASLCNNLPRIREIDLAMNYFDGSIPVGIGNCSSVEYLGLASNNLSGSIPQELFQLSNLSVLALQNNRLSGALSSKLGKLSNLGRLDISSNKFSGKIPDVFLELNKLWYFSAQSNLFNGEMPRSLSNSRSISLLSLRNNTLSGQIYLNCSAMTNLTSLDLASNSFSGSIPSNLPNCLRLKTINFAKIKFIAQIPESFKNFQSLTSLSFSNSSIQNISSALEILQHCQNLKTLVLTLNFQKEELPSVPSLQFKNLKVLIIASCQLRGTVPQWLSNSPSLQLLDLSWNQLSGTIPPWLGSLNSLFYLDLSNNTFIGEIPHSLTSLQSLVSKENAVEEPSPDFPFFKKKNTNAGGLQYNQPSSFPPMIDLSYNSLNGSIWPEFGDLRQLHVLNLKNNNLSGNIPANLSGMTSLEVLDLSHNNLSGNIPPSLVKLSFLSTFSVAYNKLSGPIPTGVQFQTFPNSSFEGNQGLCGEHASPCHITDQSPHGSAVKSKKNIRKIVAVAVGTGLGTVFLLTVTLLIILRTTSRGEVDPEKKADADEIELGSRSVVLFHNKDSNNELSLDDILKSTSSFNQANIIGCGGFGLVYKATLPDGTKVAIKRLSGDTGQMDREFQAEVETLSRAQHPNLVHLLGYCNYKNDKLLIYSYMDNGSLDYWLHEKVDGPPSLDWKTRLRIARGAAEGLAYLHQSCEPHILHRDIKSSNILLSDTFVAHLADFGLARLILPYDTHVTTDLVGTLGYIPPEYGQASVATYKGDVYSFGVVLLELLTGRRPMDVCKPRGSRDLISWVLQMKTEKRESEIFDPFIYDKDHAEEMLLVLEIACRCLGENPKTRPTTQQLVSWLENIDVSS

SEQ ID NO: 14155 - protein, 375 aa, Saccharomyces cerevisiae
MSTEEQNGVPLQRGSEFIADDVTSNKSNNTRRMLVKEYRKIGRGAFGTVVQAYLTQDKKNWLGPFAIKKVPAHTEYKSRELQILRIADHPNIVKLQYFFTHLSPQDNKVYQHLAMECLPETLQIEINRYVTNKLEMPLKHIRLYTYQIARGMLYLHGLGVCHRDIKPSNVLVDPETGVLKICDFGSAKKLEHNQPSISYICSRFYRAPELIIGCTQYTTQIDIWGLGCVMGEMLIGKAIFQGQEPLLQLREIAKLLGPPDKRFIFFSNPAYDGPLFSKPLFSGSSQQRFEKYFGHSGPDGIDLLMKILVYEPQQRLSPRRILAHQFFNELRNDDTFLPRGFTEPIKLPNLFDFNDFELQILGEFADKIKPTKVAE

SEQ ID NO: 14156 - protein, 390 aa, Enterococcus faecalis V583
MLEEVLAIHQKNIGVLSLEATEAVLNHHDLAKMYTPGVAELSLMIAQNHELAREWTISGKLIAVITDGSAVLGLGNMGTQAGLPIVEGKALLYKNLAGVDAIPLALEQKSVDEMVQTIENLQNSFAGIHLEDISAPKCFEIEEKLQQRLNIPVYHDDQEGTAIVVLAGLINAAKIKGKPLNELRVVINGVGASGVATAKLCIQAGITHLTLVDRQGVLREEDPTLNPYQRALLRQVIKPSVENKDLATAVVNQDVFLGLSEADVLTPALIKSMNQDPIIFALANPKPEIEPALAQANGVRLLATGSSKYPNQVNNILVFPGLFKGLLAAKGRKVDVGLQMTVARSLAAMISEPTVEKFIPNVFDGGVVDTVFNAVLDYIKQEKTTAEEGT

SEQ ID NO: 14157 - protein, 142 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 14158 - protein, 98 aa, Papaver rhoeas
TNVFAYPGGASMEIHQALTRSSSIRNVLPRHEQGGIFSAEGYARASGLPGVCIATSGPGATNLVSGLADALLDSIPIVAVTGQVTRRMIGTDAFQETP

SEQ ID NO: 14159 - protein, 461 aa, Shigella flexneri 2a str. 2457T
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 14160 - protein, 675 aa, Oryza sativa
IGPSLEEKQWIRRSPQQGCPPDGGAAGKLAPGSQPGTVRPGRQNARQIKWVLMLKAHRAAGRLTGAASAALAVASAARRRVASGRTDADAAPGESTALRARSYGCIRVSLVLSLLLLAVEVAAYLQGWHLEEVASLLAVDGLFAASYAGWMRLRLDYLAPPLQFLTNACVALFMVQSIDRLVLCLGCFWIRFKGIKPVPQAAAAGKPDVEAGAGDYPMVLVQMPMCNEREVYQQSIGAVCNLDWPKSNFLVQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNVNLCFHFEVEQQVNGAFLNFFGFNGTAGVWRIKALEDSGGWMERTTVEDMDIAVRAHLKGWKFVFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 14161 - protein, 271 aa, Solanum tuberosum
AQVYIDKFFELPLCEKQKAQRRVGEHCGYASSFIGGFSSKLPWKETLSFQYSDEEGSSHIVEQYFQRTLGEQFSYIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 14162 - protein, 209 aa, Zea mays
  unsure (1)..(209): unsure at all Xaa locations
DAPMFVVGVNEKEXKSDINIVSNASYTTNCLAPLAKVINDKFGIVEGLMTTVHAITATQKTVDGPSSKDWRGGRAASFNTIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIVLNGNFVKLVSWYDNEWGYSTRVVDLIRHMNSTN

SEQ ID NO: 14163 - protein, 373 aa, Oryza sativa
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQPKRRPAADYIETGRVDVTANMRAILVDWLVEVAEEYKLVSDTLYLTVSYIDRFLSAKAINRQRLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 14164 - protein, 285 aa, Oryza sativa
MAEKKKKKKKKKPQSLLVLTSWRSIGMGRGRVELKRIENKINRQVTFAKRRNGLLKKAYELSVLCDAEVALIIFSNRGKLYEFCSTQSMTKTLEKYQKCSYAGPETAVQNRESEYYKSKHRLCLVRSKVWNLVKIRDDVTEKLCMYERNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 14165 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 14166 - protein, 614 aa, Phaeodactylum tricornutum
MLASSRTAAASVQRMSSRAFHASSLTEARKFFVGGNWKCNGSVQQAADLVSMLNQSSLSQDTEVVICPSQVHLQSVQSTIRGDVAVGAQDVWTQGNGAFTGETSANMLKDLGVKWAVIGHSERRGKGEPDAQVAAKAKYALDQGLSVIACCGEPLEAREAGTTNEYVFPQIKAYVDALEPKDWDRVVIAYEPIWAIGTGLTATPEQAQDTHEAIRQYLGQVAGAEVAANTRILYGGSASAKTAPGLSAKPDIDGFLVGGASLKPEFADIVNCQGDTKSLKPVNIGINGFGRIGRLVMRAAQNDPMINIVAVNDPFIPTDYMEYMFQFDSTHGLYTGTVNMVDESNIAVDGKPIRVFNERDPSKIQWGSAGADYVVESTGVFTTTEKASAHMVGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPALNGKLTGMSFRVPTIDVSVVDLTCRLDKGAPYATICAAIKAASEGPMKGILGYQNKDVVSSDFISDSHSSIFDEKAGIALTDDFVKLVSWYDNEAGYSMRVLDLIKHMEKSK

SEQ ID NO: 14167 - protein, 277 aa, Arabidopsis thaliana
QNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYT

SEQ ID NO: 14168 - protein, 93 aa, Oryza sativa
  unsure (1)..(93): unsure at all Xaa locations
MAGTIVCGTARQILDCKCIPTDTAHACCSDGTFARAAGPTGASSGVYEALELTDGGSDYLGXGLCKAVDNLCSVIVSALISKDPASHADLDNF

SEQ ID NO: 14169 - protein, 492 aa, Glycine max; identical to SEQ ID NO: 5798

SEQ ID NO: 14170 - protein, 374 aa, Xanthomonas axonopodis pv. citri str. 306
MSLPVSRRSFLSLATTGVAVSALGLAPAAQAARKRAAAPATPGVAAAAGTVYLNLNEHPLGPAPAAIEAATRSLARSGRYLLEMEHDLRNLMTGELQLPNDHLSLFPGSRDALNRAGSLLTSARAGLVVADPSFDPLIESATARGVAVRKVPLRADGAHDVKAMAKADPTAGMLYLCNPGNATGAITPRADIEWLLANKPASAVLVVDEAYIHYSNEPSVADLVRQRQDLIVLRSFSKLYGMAGLRLGAALAPPGLQTKLAAFGSNPSSVPAMAAGIASLRDPLLVQTRRAENARVREETIAWLKGKGYTCLPSQANCFLLDVKRDASVFADSMQKQGVIVGRSWPIWPKRVRVSVGTEAEMLRFREAFGKAKR

SEQ ID NO: 14171 - protein, 110 aa, Pectobacterium carotovorum subsp. carotovorum
KACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGA

SEQ ID NO: 14172 - protein, 402 aa, Pseudomonas aeruginosa UCBPP-PA14
MDNLNSAVQVLIHGSNTLFILLGAVMVLAMHAGFAFLEVGTVRLKNQVNALSKILSDFAISALAYFFVGYWIAYGVTFFHPAAALTVDSGYALVKFFFLLTFAAAIPAIISGGIAERARFGPQLCATALIVAFVYPFFEGLVWNGNFGLQEWLKLEFGAPFHDFAGSVVVHALGGWLALAAVLLLGSRNGRYRDGKLVAMAPSSIPFLALGSWILIIGWFGFNVMSAQTLAGVSGLVAVNSLLAMVGGTMASLLIGRNDPGFLHNGPLAGLVAVCAGSDLMHPIGALATGLVAGALFVWAFTATQVRWKIDDVLGVWPLHGLCGVWGGIACGIFGQQALGGLGGVSLASQALGSLLGVTVAFAGGLLVYGLMKALLGIRLSQEEEYYGADLSIHKIGAISHE

SEQ ID NO: 14173 - protein, 251 aa, Pseudomonas aeruginosa PAO1
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 14174 - protein, 213 aa, Sinapis alba
MVRGKTQMKRIENATSRQVTFSKRRNGLLKKAFELSVLCDAEVSLIIFSPKGKLYEFASSNMQDTVDRYLRHTKDRVSSKPVSEENMQHFKHEAANMMKKIEQLEASKRKLLGEGIGSCSIEELQQIEQQLEKSVKCVRARKTQVFKEQIEQLKQKEKALAAENEKLAEKWGSHEIEVWSNKKQESGRGDEESSPSSEVETQLFIGLPCSSRK

SEQ ID NO: 14175 - protein, 808 aa, Saccharopolyspora erythraea
MTGGERVKRLVIRIAPLLLVVPLLVAAVSPVRHSQRVDELIGQLTLDEKLSFVYWDYNEKDPLAKLWLPGVPRLGIPQIRGTDGPAGVTIHQPAIAMPAPVALASAFDDRLAHEYGTVLGREGRAFEQDIILGPMVNNIRVPQAGRNFETFSEDPLVTARTAAAQIRGIHSQGLMTSAKHYAANTQETDRFTIDVDVDQRTLRELELPGFEAAVAAGATSVMCAYPKVNGTHACGHRQLLTEILKEQWGFKGWVMSDWTATHATEDLVAGLDQEMGVEVREDGSLFRGKYLGEALKKAIREGRIPESALDASVRRILTQFERFGLLDETKPPRPERDVAGGTRIAQEVAESGAVLLRNEGGVLPLDPAAGQDIAVIGPSAQQPKVTGLGSSYVEPDFANAPLDTITQRVGSGGRVGYSVGEELKGAPIPETALQPAFVPGEVTPPPSGGVIYDGRLKVDADGLYRIAARIDGGNGSLQIDGGAPIGVGDVFGPLTSVPVWLTKGEHTIQMTGAAPVGGGSLDVDLTWVTPGHAQREFDAAVERARDSDVAVVFAYDDGAETADRTSLSLPGTQDKLIDAVASVNPNTVVVLNTGSSVTMPWLDKTRAVLDMWYPGQAGAEATTALLFGDAEPGGRLTQTFPVSQERTPVGGDPARFPGVDGKVHYSEGIFSGYRWYDREGVDPLFPFGHGLSYTTFERTDPVVERTRDGLDVTVTVRNTGQRRGSDVVQVYLGPSPQVPLDQAPRQLAGYQKVELAPGETKRVRVHVAERALQHWDEAAGGWKLGGGKRAVEIGSSSRDIDLRADINL

SEQ ID NO: 14176 - protein, 472 aa, Chondrophycus papillosus
ESGVIPYAKMGYWDPNYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKELGTVIIMIDLVIGYTAIQTMAIWARKNDMILHLHRAGNSTYSRQKIHGMNFRVICKWMRMAGVDHIHAGTVVGKLEGDPLMIRGFYNTLLEPYLAVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 14177 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFAGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 14178 - protein, 476 aa, Wolbachia endosymbiont of Drosophila melanogaster
MIQNILRLLHIITVLTRYNILPYLLPPSKKSINKIQGHKLKCALEKLGPVFIKFGQSISSRTDVLNEDITNNLLLICDRLPSFSHKIAVKTIESEFNCKLSDIFSSFSEKPIAAASISQVHRAVTTEGKEVAVKVLRPNIEKTFSRDIKMLSWLAEIAEKFSEQSKRLRPIELVKTFAEICRLELDLRFEAAHSSELKENTKNDRGFYVPEIDWNRTSKKVLTLEWIEATPIYEVEKLNNRKQIAINLIESFCNQVYRDCFFHADMHPGNLMVDSNNNIIALDCGIMGRIDRETCYYVIEILKGFLNRDYDHVAKMHFRAGYVSSQHRNFVTACRAIGEPIIGQPIQKISFASLLAQLLKITGDFDMKVQTQLLLLQKTMILLEGTCRKIYSEINMWKVVEAWISSQHENKIGYREKIRSSYPVKTIQGIFSLIEKLNLIADKKLENIQIKNKSNGKVYFLLWFVIIILIVKLLIS

SEQ ID NO: 14179 - protein, 332 aa, Rhodobacter sphaeroides
MSRQEAPRPKVAVIAGGGTLTALASDPFEICDYGQAGSLTAADLIDRCAAMADRVALVPLAFEPRPSFDMGPDQWGAICGLCAAALAEDPGLAGFVLTHGTGSLEEAAFFLSLVWDLPVPLVVTGAQRPASALSSDGYMNLFQAALVAAHPQARAEGVLVVAHGEIHLPFEVTKTATFGLDTFRSPDLGPVGLVIGGQVRFLRPAAPRAPRADWRVLGALPRVDILYCHSGGDACAIEAFIAAGARGLVVAGFAPGYATGAQARRLETWVREEGGVVVMASRGHGPVVANSRNDGHGFLPAGRAAPVKARLLLQLALAAGRAPAQIARDFEF

SEQ ID NO: 14180 - protein, 369 aa, Vibrio parahaemolyticus RIMD 2210633
MKTQKQWIELKNNLNIENRAYINGEYSAALTGQTIPVVNPATDEIFTEIARCQSEDVDLAVSCARQAFQSGQWSESSPAHRKAVLKQFADLIDQHQEELALLETLDTGKPISHSFSTDIPGAANSLRWYAEAIDKVYGEVAPTEKDVHAFVSHQPIGVVAAVVPWNFPLWLACWKLGPALAAGNSVLLKPSEKSSLTAIFLGQLASQVGLPTGVFQVVTGFGHEAGDALAKHQDVDCIAFTGSTRIAGQLMVSSGESNLKRVFAEAGGKNANIVFEDCDDLDRAAAETAAGCFYNQGEVCVAATRLLVHESIKDQFIEKVIQASKAFTPKDPMNPSSSMGALIDQDHKSKVLEYISLGESEGAIRALWR

SEQ ID NO: 14181 - protein, 626 aa, Oryza sativa
  unsure (1)..(626): unsure at all Xaa locations
NISYGQQQVLSGLLPDHASLATDTDKPSTYVCTPPNLMEGHGVTKQFQGRLHVVPKHSDWFSPGIVHRLERQVVPQFFSGKSPGNTPEKYMLLRNKVIAKYLENPSKRLXFAECQGLVANTAELYDLSRIVRFLDTWGIINYLASGSVHRGLRMATSLLREEPTGELQLLTAPLKSIDGLILFDRPKCNLQAEDISSLASNSEVVDFDAGLAELDGKIRERLSESSCSYCLQPLTSLHYQSLKEADIALCSVCFLDARYITGHSSLDFQRIDGDNDRSENDGDSWTDQETLLLLEGIEKYNDNWNNIAEHVGTKSKAQCMYHFIRLPVEDGLLENIEVPDASVPFRAETNGYPHLDCNGXLQVGFLASAMGPRVAASCASAALSVLTVDDDSRVNSEGICSDSRGQGPHPNFRDHNGGVSSSISPEKVKHAAMCGLSAAATKAKLFADQEEREIQRLTATVINHQLKRLELKLKQFAEVETLLLKECEQVERIRQRIASDRVRIVSTRLASPGNSLPGGSTSTMSSNPMSMSPRPMGVPGSMPQSSMPAPFANNMQGHGHPQMAFLQQQQRQQMLSFGPRLPLSAIQTQPSPQTSNIMFNPGMPNSVTPNHHQLLRSSSGNNSSVG

SEQ ID NO: 14182 - protein, 666 aa, Bassia scoparia
MASTCANPTFTPFTSKPLKPRSPFHSFPFPSNPKTPSSSFRNLKITSSLSSSQPPKPPSAVKTHSPPSPLTTDEPPQGFVSRFAPDQPRKGCDVLVEALEREGVTDVFAYPGGASMEIHQALTRSDSIRNVLPRHEQGGIFAAEGYARATGRVGVCIATSGPGATNLVSGFADALLDSVPLVAITGQVPRRMIGTDAFQETPIVEVTRSITKHNYLVLDVEDIPRIVKEAFFLANSGRPGPVLIDIPKDIQQQLVVPDWDQGVRLGGYVSRLPKSVFSANDEGLLEQIVRLMSEAKKPVLYVGGGCLNSGEELRKFVELTGIPVASTLMGLGAYPCNDDLSLHMLGMHGTVYANYAVDKADLLLAFGVRFDDRVTGKLEAFASRAKIVHIDIDSAEIGKNKQPHVSICADVKYALKGMNKILESRKGKLKLNYSSWREELGEQKKKFPLSFKTFGEAIPPQYAIQMLDELTNGNAIISTGVGQHQMWAAQHYKYRNPRQWLTSGGLGAMGFGLPAAIGAAVARPDAVVVDIDGDGSFIMNVQELATIRVENLPVKIMLLNNQHLGMVVQLEDRFYKANRAHTYLGNPSKESEIFPDMLKFAEACDIPAARVTKVGDLRAAMQTMLDTPGPYLLDVIVPHQEHVLPMIPSGAAFKDIINEGDGRTSY

SEQ ID NO: 14183 - protein, 220 aa, Bacillus anthracis str. A2012
MEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 14184 - protein, 209 aa, Clostridium tetani E88
MSKRPILIGITGGTGSGKSTVSKEICRRFDKELIVMIEQDSYYKDQSHLSIEERVKTNYDHPNAFDTELLVKHLKELSYWSKVEKPIYDFELHNRKNETEIVEPTEIIIVEGILVLEEKEIRDLLDIKIYVDTDADVRIIRRLVRDIKERGRSLDSVINQYLNVVRPMHMQFIEPSKRYADIIIPEGGHNKVAIDIIVGNIKQMVQKSE

SEQ ID NO: 14185 - protein, 452 aa, Dactylis glomerata
MAQEEKEKPDESTSSRRPQAKETKPNPAPEPEPEMATVAMDISKPPPAAAGDDSAKGARAGGEGLRQYYLQHIHDLQLQIRTKTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSTTMNLMRGIDLKKIAGKMNGASGAELKAVCTEAGMFALRERRVHVTQEDFEMAVAKVMKKDNEKNMSLRKLWK

SEQ ID NO: 14186 - protein, 522 aa, Beta vulgaris
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 14187 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVVKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 14188 - protein, 475 aa, Staphylococcus epidermidis ATCC 12228
MRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 14189 - protein, 220 aa, Streptococcus agalactiae 2603V/R
MSTNKIAPSILAADYANFANELKRIEETTAEYVHIDIMDGQFVPNISFGADVVSSMRKHSKLVFDCHLMVVDPERYIEAFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 14190 - protein, 366 aa, Zea mays
  unsure (1)..(366): unsure at all Xaa locations
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGHGQGAAVVVVPKAAGSKNEWVLCRVFKKSLVVGGAAAAAAPTAGKRGGTETSSNYKTGDVEAIAHLPPLMDVSGSGSGAGAAAAAAAHVTCFSDALEGQFLDQTTTTPPPEAATAATDDDGHLGRXGASSSPFQLPGFAHYYYGGGPPHLHQHHGAASLVQLLEGSVPPCNKGGERERERLSASQDTGLTSDVNPEISSSSGQRFDHDHDHDHHLCCWGY

SEQ ID NO: 14191 - protein, 300 aa, Zea mays
  unsure (1)..(300): unsure at all Xaa locations
MNFCRHLLLAAVFALLLAVCASAASRGAGSFDPSRVVQLSWRPRAFLHKGFLSDAECDHLIALAKDKLEKSMVADNESGKSVQSEVRTSSGMFLERKQDEVVTRIEERISAWTFLPPENGEXIQILHYQNGEKYEPHYDYFHDKKNQALGGHRIATVLMYLSNVEKGGETIFPNAEGKLLQPKDNTWSDCARNGYAVKPVKGXMPLLFFSLHPDATTDSDSLHGSCPVIEGQKWSATKWIHVRSFDLPVKQPGSSDGCEDDNILCPQWAAVGECAKNPNYMVGTKEAPGFCRKSCKVCAE

SEQ ID NO: 14192 - protein, 386 aa, Oryza sativa (japonica cultivar-group)
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENSDGDFNTGSQIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 14193 - protein, 312 aa, Photobacterium profundum
MANTADYIWFNGEMVPWAEANVHVLTHAMHYGTSVFEGIRCYNTPNGPIVFRHKEHMDRLKNSAKIYRFPIPYSSEELMEICRETIRVNELESAYIRPLGYVGNVGLGVCPPVDTEMDLIVAAFPWGSYLGEEALESGVDAMISSWNRAAPNTIPTAAKAGGNYLSSLLVGSEARRHGYAEGIALSVDGYLSEGAGENIFVVRNGILSTPPATCAILPGITRDSIMVLAKEMGYEIREENIAREALYLADEVFMTGTAAEIVPVRSVDQISVGEGKRGPITKEIQAAYFGLFNGTTEDKWGWLDYVYPKSDK

SEQ ID NO: 14194 - protein, 815 aa, Bifidobacterium longum DJO10A
MTEITAPKSPVTAEQFADEIREQLKYTQNVTTEQATPADVYVAASKAVRNHLADSWFKTQADTVNGNTKAVGYLSAEFLMGKQLRNALLNAGLTEQFDKAVEALGFKVQDVVDAEYEPGLGNGGLGRLAACFIDSLASLGVPAFGYGIQYKYGIFKQEFDKDGKQVETPDYWLANEEPWGHIDYNRDQKVSFGGKVVENADGTKTWQPAWSVRAVPVDYLVPGYKSGRVNTLRLWSAKSYDEFDLLAFNRSEYMEAVTPQVKAENISKILYPEDSTKVGKELRLEQQYFFVSASLHDAIRVFYPGQDKPDLTTFPNKIVFQLNDTHPVIGIPELMRILIDEYGYDWDTAWSITTKTFNYTCHTLLPEALEVWPASLIGELLPRHLEIIEKINAQFEDELKSKGVDKNTIKDMAIYTGDAVRMAYLATYGGSHVNGVAELHSQLLKDVTLKNFSDVYPDKFTNVTNGVTPRRFVKLANPRLSDLITEGLGTDKWLSDLEMLKGLEPLAKDDEFVKKFAAVKKANKHAFVGFAKDHYGIDIDENTLFNTMVKRLHEYKRQSLKILAVISTYADIKSGKVKAEDVTPRTVFFGAKAAPGYYLAKMTIQLINNVSRVVNNDPDVKGKLAVYFPWNYNVRLAQHLIPATDLDEQISQAGKEASGTGNMKFALNGAMTVGTLDGANVEIRERVGAENFFLFGMTVDEVEKKYAEGYNPASYYEADPRLKHAIDMVADGTFSNGDRNAYSPLVADWLTKDWFMTLADFSAYMDIQSEIEALYADELEWNRKALLNVANSGYFSSDRSMEDYLERIWHTAPLA

SEQ ID NO: 14195 - protein, 140 aa, Oryza sativa
MISAKRLVQLAKWQRMAALGRKRIMGKAQETEECSTSVAVKGHCVMYTADGRRFEVPLAYLGTVVFSELLRMSQEEFGFTSDGRIVLPCDAAEMEYAMCLLKRNPSVEVVDALLSSMLIRCHCTGSMVPTVGVNQQISCL

SEQ ID NO: 14196 - protein, 340 aa, Lactobacillus plantarum WCFS1
MSVKIGINGFGRIGRLAFRRILELGEKSSDIEVVAINDLTSPALLAHLLKYDSTHGTLNADVSATDDSIVVNGKNYRVYAEPQAQNIPWVKNDGVDFVLECTGFYTSKAKSQAHLDAGAKRVLISAPAGSDLKTIVYNVNDDILTADDRIVSAGSCTTNCLAPLAFFENKEFGIKVGTMTTIHAYTSTQMLLDGPVRGGNFRAARAAGVNTIPHSTGAAKALGLVIPELNGKLQGHAQRVGVVDGSLTELVAILDKKVTADEVNAAIKKHTEGNESFGYNDDEIVSSDVIGTTFGSIFDPTQTEVTSDGDNQLVKTVAWYDNEYGFTCQMVRTLLKFATL

SEQ ID NO: 14197 - protein, 389 aa, Photobacterium profundum
MLSECCHNYRDSKLSLLYTSAVDYFCSTDMTLKVAINGFGRIGRSVLRALYESGKHHHINVVAVNELAEPEAMAHLLQYDSSHGRFFKPVSHDQEHLFIAHENGERDDIRILHQSDITLLPWHDLDVDIVLDCTGVYGSREDGLAHIKAGAKKVLFSHPAANDIDNTIIYGVNHKTLTSEHRIVSNGSCTTNCIVPVIKIIDDAFGIESGTITTIHSAMNDQQVIDGYHSDLRRTRAASQSIIPVDTKLHLGIGRIFPKFVDKFEAISVRVPTINVTAMDLSVTVKTNVKVNDVNQALSEVSRCTLEGIVDYTEAPLVSIDFNHDPHSAIVDGTQTRVSNKHLIKLLVWCDNEWGFANRMLDTALAMHASDAAQHSNKELRSKIAIKNS

SEQ ID NO: 14198 - protein, 486 aa, Gelidium elegans
NSVEERTRIKNQRYESGVIPYAKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 14199 - protein, 657 aa, ASPERGILLUS NIDULANS FGSC A4
MSTPSTATATHPVTHHHQHYGFPHHQTYLPNPSYPTTSSPHLNSTVYPYAVPSTTAALPYTQSPHSAAAASTATSTAAMPQPPKPASTGVSTQNGRRKKPDWGEFYKNGIPKEVIVIDDTPPPDQSAAASRTYPTASTAQVANGNTAQPAGKRRRTGIETAYDLGYFDRPSFSTNPQHYGEESSAGSLSTDRTASLHTTAPTSLSQGSSGASNGAYYEDANVGQKRKRVATRKSVRDQQKKLEQETATDAFLSYIPPPKPPIKAKDVPVPVVRSYANRGEKYDDDDGHYIVNPNTPITDRYSIIKLLGQGTFGKVVEAYDKQRKARCAIKIIRSIQKYRDASRIELRVLSTLASNDKHNRNKCIHLRDCFDFRNHICIVTDLLGQSVFDFLKGNGFVPFPSSQIQSFARQLFTSVAYLKPENILLVKNAYQTFTYNRTIPSSSTAISRNARQRRVLLDSEIRLIDFGSATFDDEYHSSVVSTRHYRAPEIILNLGWSFPCDIWSIGCILVEFFTGDALFQTHDNLEHLAMMEAVIGERIDPKLVRQVMQGGRNGNQNQAAKYFVRNRLDYPNEETTRASKKYVQAMRRLTSFMPTNTKFYRLFLDLLQRIFVYDPKQRITAKDALKHPWFKEPITDDGTEALRIGQQLQQRNNGQQR

SEQ ID NO: 14200 - protein, 472 aa, Rhodobacter sphaeroides
MRNIDRFFIGGAWTAPLGTDRHRLVNPATEEEIAAIPMASTEDVDRAVTAARAAFEGWQASSKEERLLLLRRLLDLYNEAYDELAELMTREMGTVARFSREAQAWVGRAHLEAAIEALEAESFEEMRGSTLISKEPIGVCALITPWNWPMNQLVVKVAPALAAGCTVVAKPSEFSPLSSIRFAELVEAAGFPPGVYNHITGAGPVAGEALARHPDVDMISITGSTRAGIAVARAAADTVKRVTQELGGKSANIILPDADLATAVRQGVLDCFGNAGQACKAPARMLVPAERMEEAAALAGAAAEALTVGAPEGEVDLGPVVNESQWRRIQSLIEAGIAEGARLVTGGPGRPDHLPRGWYVRPTVFADVAHGSTIATEEIFGPVVALIPYRDEEEAVRIANDSIYGLAGYIQTGDPETARRIARKLRVGMVYINGAGWDARAPFGGYKQSGNGREHGAWGLADYLETKATAGL

SEQ ID NO: 14201 - protein, 487 aa, Corynebacterium glutamicum ATCC 13032
MMEQDLSYREILPLNASEEKKKAALIDAIEGLRVRDPLLSASIAFTRGQKVAFIAVVVGFILMLIFARQAALIGLSATCTFMYLITLLDRFIMFSRGIRAESIIQVSDEDALAFPEDKLKTYTVLVPAYGEPEVIAQLLASMHAFDYPKHLLQVLLMLEEDDLPTIAAAEAAGVDQVATIIKVPPAQPRTKPKACNYGLHFATGEIVTIFDAEDMPDPLQLRRVVVAFERSASNTVCVQSRLSYRNARQNLLTAWFTIEYDVWFNFLLPGVMRMNAPVPLGGTSNHLLTGVLKDLGAWDPFNVTEDADLGVRIAAKGYSTAVLDSVTWEEANSDTINWLRQRSRWYKGYLQTWLVYMRRPKWLVQELGIIPAVRFTFLMAGTPIIAVLNLLFWYLSLTWILGQPGTIEQMFPPAVYYPALVCLVVGNAATIFMNLIGCREGRDPLLLIAVLTFPLYWLLMSIAALKGTWQLITRPSYWEKTAHGLEA

SEQ ID NO: 14202 - protein, 166 aa, Triticum aestivum
MDVGRAVLVQNEERTRLDAGTWGTVGVGLGYCVAATVGGPPERLVVAVEGDSGFGFSAMEVETLVRYQLPVVVIVFNNNGVYGGDRRGPDELTGPYKDDPAPTSFVPGAGYHKMMEAFGGKGYLVETPDELRSALSESFRARKPAVINVTIDPYAGAESGRMQHKN

SEQ ID NO: 14203 - protein, 145 aa, Zea mays
  unsure (1)..(145): unsure at all Xaa locations
MDLLDARHRHTPDLSSSQDAASNMGLPLAGAAYQPYVSELLSFSIERLHKEPELLRVDAERVRRQMQEVAVENYAAFIAASEALSFVRAQLESFDGHLEAXCIRNGNYDEALDLEAFVSKIWKLHPDLPVVQGLATEVKKTVQSL

SEQ ID NO: 14204 - protein, 198 aa, Prochlorococcus marinus subsp. pastoris str. CCMP1378
MFLVIDNYDSFTYNLVQYLGELSVEHNITKELLVKRNDEITLEEIRHINPDGILLSPGPGNPDQSGICLAILQNLSKEIPILGVCLGHQALAQAYGGKVIVGKELMHGKTSKIIHNKKGLFKDIDSPFVATRYHSLIVDSESLPSCFEITATLEDSTIMAISHKEYKKLHGVQFHPESVLTQFGHKLISNFLNMAEQK

SEQ ID NO: 14205 - protein, 376 aa, Bacillus anthracis str. A2012
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRDWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 14206 - protein, 399 aa, Zea mays
MLLSSHASAHASEKKIHARRSVFLAGCPGPVRNSSFLHTYSRKLLVRACSTCTYALVNRRPRAPLRPDTSPLPRTGPWRESAGACQSGKPRPPLVGPSSLRLLCWSAPPNSTMPAAASHPSPTGPLVARPPASSSPPAGRPASQTLARRAREKLDAMFGYRKADPDLEAGGSSLLYPGMTESPELRWAFVRKIYVILTVQLAMTAAVSAFVVKVPAVSNFFVSSNAGIALYIFLIVLPFIVLCPLHYYHQKHPVNLLLLGLFTVAISFAVGMTCAFTSGKIILEAAILTAVVVNSLTAYTFWAAKRGHDFNFLGPFLIAAIMVLMVFSLIQIFFPLGKISVMIYGGLASLIFCGYIIYDTDNIIKRHTYDQYIWAAVSLYLDVINLFLSLLQLLRAADS

SEQ ID NO: 14207 - protein, 623 aa, Chlamydomonas reinhardtii
MATTESSAPAATTQPASTPLANSSLYVGDLEKDVTEAQLFELFSSVGPVASIRVCRDAVTRRSLGYAYVNYNSALDPQAADRAMETLNYHVVNGKPMRIMWSHRDPSARKSGVGNIFIKNLDKTIDAKALHDTFSAFGKILSCKVATDANGVSKGYGFVHFEDQAAADRAIQTVNQKKIEGKIVYVAPFQKRADRPRARTLYTNVFVKNLPADIGDDELGKMATEHGEITSAVVMKDDKGGSKGFGFINFKDAESAAKCVEYLNEREMSGKTLYAGRAQKKTEREAMLRQKAEESKQERYLKYQSMNLYVKNLSDEEVDDDALRELFANSGTITSCKVMKDGSGKSKGFGFVCFTSHDEATRPPVTEMNGKMVKGKPLYVALAQRKDVRRATQLEANMQARMGMGAMSRPPNPMAGMSPYPGAMPFFAPGPGGMAAGPRAPGMMYPPMMPPRGMPGPGRGPRGPMMPPQMMGGPMMGPPMGPGRGRGGRGPSGRGQGRGNNAPAQQPKPAAEPAAAPAAAAPAAAAPAAAAEPEAPAAQQPLTASALAAAAPEQQKMMIGERLYPQVAELQPDLAGKITGMLLEMDNAELLMLLESHEALVSKVDEAIAVLKQHNVIAEENKA

SEQ ID NO: 14208 - protein, 488 aa, Cyanidium caldarium
MAQSVQERTRLKNKRYESGVIPYAKMGYWDPNYVVKDSDVLALFRVTPQPGVDPIEAAAAVAGESSTATWTVVWTDLLTACDVYRAKAYKVDAVPNEADQYFVYIAYDIDLFEEGSIANLTASIIGNVFGFKAVKGLRLEDMRIPFSYLKTFQGPATGVIVERERLNKFGRPLLGCTCKPKLGLSGKNYGRVVYEGLKGGLDFLKDDENINSQPFMRWRDRFLYVMEGVNRASAASGEVKGSYLNVTAATMEEIYKRAEFAKEVGTVIIMIDLVIGYTAIQSMAVWSRENNMILHLHRAGNSTYSRQKNHGINFRVISKWMRMAGVDHIHAGTVVGKLEGDPVIIKGFYNTLLLPKLEINLPQGLFFEMDWASIRKVMPVASGGIHAGQMHQLIHYLGEDVVLQFGGGTIGHPDGIQAGATANRVALESMILARNEGRDYFNEGPQILRDAAKNCGPLQTALDLWKDISFNYTSTDTSDFVETPTANV

SEQ ID NO: 14209 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 14210 - protein, 117 aa, Beta vulgaris
  unsure (1)..(117): unsure at all Xaa locations
ILLILLTILQXFADQSPGXHXXIVXEXLGNVSGHPYXVHTNVFSQGKGNXEQQFHLWFDPTRNFHTYSILWSTKLIMFLVDEIPIRIFRNHEKHGVAFPKNQPMRLHSSLWNADDWA

SEQ ID NO: 14211 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQEVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 14212 - protein, 209 aa, Listeria monocytogenes EGD-e
MTKKPIVVGVTGGSGSGKTSVTKAICNHFSGHSILMIAQDVYYHDQANISFEDRLKVNYDHPLAFDTDLLISHIAALRRYESIEKPIYDYAKYTRKKEVEIQEPREVIILEGILILEDKRLRDLMDIKVYVDTDDDIRFIRRLLRDMKERGRTMDSVIEQYLSVVKPMHNEFIEPTKKFADIIIPEGGENHVAIDLMTTKIESILQKHV

SEQ ID NO: 14213 - protein, 702 aa, Neurospora crassa
MAPSKDSKRGSKTPESNINNSTTSNSNGGGGNASRDSRHTGLFLPLFGLRLSPRHKRRIETERDRMLSDPDRHSHLRRGRMTPPAPTVDVELKPLDDRQPNMKFALRPGSVVAKLEQLVRRRYQDKGHPIATAAHFAFYVDGRVLNPEDVLPPTSFKIWYRMSRSSAEVDQWKFSQYKDANNQPIPPELAAQLVQAIDTGGATVGELRRKIAAFMSISDPDRVLLVARGGTRPGQLQGDSWVVSEIKRHWLCCWISYHITRTNAYAVINGLGRRYVYHPESHYFYDGMSVRRWQHHLDTRLFRNVRSRGKTGFNAHWSEIILTLNGTRVSKTTRVCWGKTYEVELSGQAAKIFSAEEAWLLPDEACSVCLDSKNLSLMAYKITSGCNHKPTICNACLSQWIASELETKMWDRIKCPECPKSLEFADVQRNASKTVFRRYDELATRAALGNIPNFRWCKSSKCNSGQIDDVRCVRFKCKACKNSHCIKHDVPWHSGETCEEYDKRNTQKKKDERASEAEITKSSKKCPSCNKAVHKFSGCNHITCICSHEWCYVCLAPFQRNEHGFLYCRHKPECTERDPFVDLIDPQNANADPRTFFEAANHGLFPPQFFRNRLRVVRGRAARHHLEAGANELGVGQMGRNLNRFHPDMFLPPWMQEADRGMFAGVAGIADHVANGNGNDRDPMHDMRVLAQDMRAARRERA

SEQ ID NO: 14214 - protein, 162 aa, Leptospira interrogans serovar lai str. 56601
MWVAQYYPFRKQGSFLTSGGLGTMGFGLPAAIGAALVFPEKRIVCISGDGSILMNIQELDTLRELNLDVTILLINNGHLGLVRQQQELFFSSRFSASKFVIPANFIKIASSFGIPSFELSNECSQVEILEQALIRKGPSFVLLSGRARSTSSSHGSSRKGKP

SEQ ID NO: 14215 - protein, 404 aa, Mycobacterium tuberculosis H37Rv
MREVPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRENATAFGCIDADDSGRIRSFVEKPLEPPGTPDDPDTTFVSMGNYIFTTKVLIDAIRADADDDHSDHDMGGDIVPRLVADGMAAVYDFSDNEVPGATDRDRAYWRDVGTLDAFYDAHMDLVSVHPVFNLYNKRWPIRGESENLAPAKFVNGGSAQESVVGAGSIISAASVRNSVLSSNVVVDDGAIVEGSVIMPGTRVGRGAVVRHAILDKNVVVGPGEMVGVDLEKDRERFAISAGGVVAVGKGVWI

SEQ ID NO: 14216 - protein, 523 aa, Hordeum vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 14217 - protein, 497 aa, GIBBERELLA ZEAE PH-1
MGSRMTPEAIKPVMLIDGQANACLIQLVGASDGNSFPLFNPATGEKVADVPEATEDDTNRAVAAAQRAFPEWSAMDPAKRGSYLKKLASLIKEHNEELALLEAKSMGRPLAEFFEGHIAASSYEHYAEAWPHIQGQASLNTPGYVTMTLRQPFGVVAAIIPWNASLLFFASKSAPALIAGNTVVVKSSEKAPLGAAKFAELIHKAGFPPGVFNVLSGHGNPSGATLASHMDVRAISFTGSSPTGRAIQEAAAKSNLKKVILELGGKSPVIIFDDADLEQAAKDTMYSIQWNSGQVCMANSRVYVQDSIADNFIQACKKALSAAKSGNPTEKGINHGPQADKVQYEKVMSYINEGKKSGTLELGGNGNLDKTGGFFVEPTIFLNTPEDAKVMKEEIFGPVVNINVIKTEEEAIEKANDTEYGLYAAVYTKNVDRAMRVTQKLNSGYVGINCTSPTTARDLPFGGYKSSGQGREGWLYSLDNFLEVKSVMMKVDSGSKL

SEQ ID NO: 14218 - protein, 558 aa, Xylella fastidiosa Dixon
MFGNGSMKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARIIIETALGKSVESAFAHFDTVPLASASISQVHAATLHDRREVVVKVLRPDIEHQISDDIALLKSLATLVEHTHPNADKIRPREIVAEIETTLAAELDLQREGANASVLRRFWEASDDIYVPEVIWSHTAERVLTLERMYGIPSDDIALLDASGIDRKALSSKGIRVFYTQVFRDNFFHADAHSGNIWVDSDPARKSNPRFIALDFGIMGQLSQKDQYYLAENFMAIFHKDYRRIAELHVEAGWIPQHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGTIPVWSLISGCVGALALFSAWWRS

SEQ ID NO: 14219 - protein, 284 aa, Triticum aestivum
MARFCCFGAGCSELTGHASTTSGKGKGCQGQVKVSYGFSLVRGKTNHPMEDFHVAELAEVKGNELGLFAIYDGHLGDTVPAYLQKNLFPNILNEEEFWTHPDRAITKAYEKTDKAILSHTPDLGQGGSTAVTAILINGSKLWVANVGDSRAVLLKGGEAIQMSIDHDPNAERGAIENKGGFVSNMPGDVPRVCGQLAVSRAFGDRNLKSLLKSEPDVKVEDIDHTAELVVLASDGVWKVMNNQEAVDVVKRYKDPQTAAKQLVAEAVKRDSKDDISCVVVRFKM

SEQ ID NO: 14220 - protein, 353 aa, Shigella flexneri 2a str. 301
MRLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 14221 - protein, 371 aa, Kluyveromyces wickerhamii
MLRLTQTKTISPLRAAIGSIRTMASVPETQKGVIFYENGGKLEYKDIPVPVPKPNEILINVKYSGVCHTDLHAWKGDWPLATKLPLVGGHEGAGVVVGMGSNVKGWKIGDLAGIKWLNGSCMSCELCEQGFESNCAHADLSGYTHDGSFQQYATADAVQAAQIPKGTDLAEVSPILCAGVTVYKALKSANLKAGDWVAISGAAGGLGSLAVQYAKAMGYRVLGIDGGADKGKLVKELGGEVFIDFTKSKDMVADIQEATNGGPHGVINVSVSEGAINASTQYVRPTGTVVLVGLPAGAVIKSEVFSHVVKSINIKGSYVGNRADTREAIDFFVNGKVKSPIHVVGLSELPSVYELMEQGKILGRYVVDTSK

SEQ ID NO: 14222 - protein, 355 aa, Gibberella fujikuroi
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDLGSALDLLEKLLAFNPVKRITVEEALKHPYLEPYHDPEDEPTAPPIPEEFFDFDKHKDNLSKEQLKQLIYQEIMR

SEQ ID NO: 14223 - protein, 212 aa, Chloranthus spicatus
IENTTNRQVTFCKRRNGLLKKAYELSVLCDAEVALIVFSTRGRLYEYANNSIKSTIERYKKASADSSSTTSIAEANTQYYQQEASKLRQQIHILQNSNRHLMGDALSSLSIKELKQLENRLERGITRIRSKKHELLFAEIEYMQKREADLQNDNMYLRAKIAENENAQQANMLPGPEFDTLPTFDSRNYFQANILEAAPQYSHQDQTALHLG

SEQ ID NO: 14224 - protein, 446 aa, Zea mays; identical to SEQ ID NO: 8390

SEQ ID NO: 14225 - protein, 244 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSRVEISQYLPLLLKLVVLAYAALCLGELLHRWSSGGSCSLSPWCA

SEQ ID NO: 14226 - protein, 164 aa, Triticum aestivum
  unsure (1)..(164): unsure at all Xaa locations
MEGRMFGLETPLMTALQHLLDVPDGEAGGPGXNAAGEKQGPTRAYVRDARAMAATPADVKELPGAYAFVVDMPGLGSGDIKVQVEDERVLVISGERRREEKEDAKYLRMERRMGKMMXRKFVLPENADMEKISAVCRDGVLTVSLEKLPPPETKKPKTIQVQVA

SEQ ID NO: 14227 - protein, 672 aa, Neurospora crassa
MLRTSLRSVRALGSRPSAAVAGRQWQATVVRRAAVSGQRFFADDKKPVVPEPSQPAVLPASETLTSPSTPPPASPQVEPTSTVPPETTPLTPPTPEATVIPPVAEEPVVPPTLPTPRKKKGFFRRLRNFFLSLTILGAIAFGGGVYYSRINDAFHDFFTEYIPYGEQAVLYLEELDFKKRFPDVVSRVTGRPRDSGEQVKVPAQSGASWRVASGGEPAGRQSSSIKKAGAAAQDAVPKSEPAVVAAAKEDTAELPKTEATTTATPAEPAPAPAATDASGTPVKKPFKAPEVDEPSRWPPASPIDPLTVNGATDPIVQDLVKMLNDVITVINHDNANEKYAPTICKAKNELSKVADKINEMKAKVEADAAKQVKARVDGFDKAANELVSRVESAMAAQEAAWRREFEEEITRLKKSYDEKVHLIQDREHQIAEEKLNNRLLEQAIQLQRQFTENIKKHVEQERDGRLGKLNELHKAVAELERLTSGLNEVVDTNLRTQQLHVAVDAVRASLEDAHHPRPFIKELVALKEIAADDPVVDAAIASINPTAYQRGIPTTAELIDRFRRVATEVRKASLLPEDAGVASHASSYVLSKLMFKKEGLAAGDDVESILTRTQTYLEEGDLDNAAREMNGLKGWAKTLSRDWLGEVRKVLEVQQALDVIQAEARLQSLRVE

SEQ ID NO: 14228 - protein, 244 aa, Corynebacterium glutamicum
DHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 14229 - protein, 626 aa, Dechloromonas sp. RCB
MHKEQDKKRLATLTLAALGVVYGDIGTSPLYSIKEVFGGAHHPVPITPDNVLGILSLFFWSLIIVVTLKYVSFIMRANNRGEGGIIALMTLAMHKGVAGSWQQKMLVLLGLFGAALFYGDGIITPAISVLSAVEGLEILTPAFKPYILPITLITLIGLFIFQRRGTASVGALFGPVMVIWFAVIAVLGAAAIVENPAVLAAVNPVHAFHFLTGNSLLGFFALGAVVLCITGGEALYADMGHFGAKPIQYAWLGYVLPALLLNYFGQGALLLADPSSVENPFYLLAPEWGRYPLVALATVATVIASQAVISGAFSITQQAIQLGYTPRLEIQHTSDEEIGQIYLPAINWMMLIAIIALVIEFGSSSNLAAAYGIAVTGTMLITNILAIAVAVRLWNWSPARAMLGALPFICIDLGFFLANSVKIADGGWFPLAFGLAVFILLTTWKRGRELLGLRLAADAMQLKSFVVDIAGSGIGRVPGTAIFMTPDPELVPHAMLHSLKHYKALHEQVVVMSVKVFDVPYVPDVDRVEVHRLSNNFSQVVVQYGFKDDPDIPAALALCGEAGLAIEPMDTSFFLGRETLIPKLGSEMAYWRELLFVAMFRNAGSATAFFKIPSNRVVELGSQVVL

SEQ ID NO: 14230 - protein, 434 aa, Brassica napus
MGKENVVSRPLTRAFASALRASTTENQQRANTKRPASEDVNVTAPPNKKKKRAVLGDISNASFSAAKLEARDIKQVKKSQGLASASCVTSEVTDLQSGTEAKAEVVSVTAGNTNDTADNCIEKHKLPPRPLGRSSASIVEKSGVIRSSTALDLPKFTDIDSDDKDPLLCCLYAPEIYYNLRVSELKRRPVPNFMERIQKDVTQSMRGILVDWLVEVSEEYTLVPDTLYQTVYLIDWFLHGNYLERQRLQLLGITCMLIASKYEEINAPRIEEFCFITDNTYTRDQVLEMENQVLAHFSFQIYTPTPKTFLRRFLRAAQASYLIPRRELECLASYLTEVTLIDYHFLKFLPSVIAASAVFLAKWTLDQSNHPWNPTLEHYTTYKASDLKASVHALQDLQLNTKGCPLSAIRMKYKQEKFKSVAVLMSPKLLDTLF

SEQ ID NO: 14231 - protein, 311 aa, Nostoc punctiforme
MKNEKWNTENILSQKGRVAIVTGSSSGIGYETARVLANKQASVIIAVRNLDKGNKALAKILQQNKDADVKVMELDLANLASVKNFAENFQKNYVRLDLLINNAGVMIPPYSKTTDGFELQFGTNHLGHFALTGQLLERLIDTEDSRIVNVSSGAHSIGKIDFDDLNWEKRSYAKWKAYGDSKLANLYFTYELDRKLKDKGIDTLVTASHPGWTATELQRTAGGVVKYLNGILAQDITMGALPTLRAATEAGLKGAEYFGPNGFMEMRGYPIKVESNELSKDQAIAKKLWEVSEKLTNVKFEFNKKTQSAGK

SEQ ID NO: 14232 - protein, 354 aa, Vibrio parahaemolyticus RIMD 2210633
MTKNLFRLSTITLGLCLSSLSFAQSDLPNIKILATGGTIAGAGQSATESNYTAGKVGVESLISAVPSMTNIADISGEQVVSIGSQDMNDEVWLKLAKRVNELLAQDDVDGIVITHGTDTLEETAYFLDLTVKSDKPVVIVGAMRPSTAMSADGPVNLYNAVVTATDEDSKGRGVLVAMNDTIFDARDVTKTNTTSVSTFQSPNFGPLGYIHNSDAKYQRSPERKHTTETPFDVSKLNTLPKVGIVYNYANASSLPVKALVDAKFDGIVSAGVGNGNLYHTVFDELEKASKDGIVVVRSSRTPTGSTTLDAEIDDDKYGFVASGTLNPQKARILLMLSLTQTKNYQDVQKMFQYY

SEQ ID NO: 14233 - protein, 439 aa, Thermotoga maritima
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTGDNAQTVKLVIKTMAIFHGYHATFMPKPFYGVNGSGMHVHMSLFRGDKNAFYDPDDPLGLSKELRYFVGGILKHAKRLAAVTNPTINSYKRLVPGYEAPVYISWSVGNRSALIRIPKARGKATRLEYRSPDPTCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 14234 - protein, 722 aa, Novosphingobium aromaticivorans
MRVSAGAPRRAQDLQEGWKFMATPTKGKAPARAAKERSPALDNALRDHQPGAGQTDEATALGNAGEIHQEAAAENDAAAFLTDNFGHRLSDNQNSLRAGMRGPTLIEDFILREKIFHFDHERIPERIVHARGSGAHGVFEVTRAIPDLTRAGLFQKKGQTCPVFVRFSTVAGGAGSIDTPRDVRGFAVKFYTDEGNWDLVGNNIPVFFIQDAMKFPDLVHSVKMEADRGYPQAASAHDTFWDFIGLMPESMHMIMWAMSDRAIPRTLRMMEGFGVHTFRFVNAAGEGRFVKFHWKPVLGMESLIWDEAVKVAGADPDFHRRDLFESIAAGHFPAWDLGVQVFDEEFAASQPYDVLDATKLIPEEDVPVEIVGRMTLNRNVDNFFAETEQVAFLPSNVIPGIDFSNDPLLQGRLFSYLDTQKSRLGTTNFHQIPVNAPKCPFHNMQRDGLMQTLVPTGRANYEPNSLDEAGEDSGPRACPETGFTSFRENGERHDPTEKVRVRADLFADHYSQAALFFHSQTESEQAHIASALVFELSKVALEHVRARVVSRLRNIDETLAQRVADGLAMDLPEKAPAARQPVKMKPSDALSIQKQAKKTFAGRKVGILFAEGSDKATIDKLKAGVEEAGGTVFLVAPKVGGIPVKGGTLKADGKLDGSPSVLFDAVASVLMPEAAAKLAMQGAAVQWFMDAYGHCKTIAHCNGTRIILEKAGVEPERGRGAQ

SEQ ID NO: 14235 - protein, 202 aa, Glycine max
MGFNILRTTSISTPISSSKSKPIFSTLLRSSPSTIFPPKSVTPTTLFVSATPFFTLHPKLGFRGGIVAMAAPGSLRKSEEEWRAILSPEQFRILRQKGTEFPGTGEYDKFYEEGVYNCAGCGTPLYRSLTKFNSGCGWPAFYEGIPGAINRNPDPDGMRTEITCAACGGHLGHVFKGEGFPTPPNERHCVNSISLKFAPANF

SEQ ID NO: 14236 - protein, 210 aa, Triticum aestivum
  unsure (1)..(210): unsure at all Xaa locations
MAGTSSWSSSSSCASSSGSPDHDVVCVTEPDSVGAAGAVADAEGSVKFLCSYGGRILPRRTDGTLRYVGGDNRVLSVDRPIRFYVLQRKLRELCGGWEAXLRCQLPTEDLDALISVTCDDDLAKLLEEYDEASKDRLQSLKIRAFLFPTRTPAPSILQRRSPPSIAHLHWQNTSPPPAAAGVSLTCAPRWWAAPQASRQAQNYDRHSLGE

SEQ ID NO: 14237 - protein, 468 aa, Brassica napus
MNVMRRLKSIASGRTSISSDPGVDSSLKRPKLDQDNDNLSSRGDDPMQVDQSTDMVVVSQDTVAGTSNVPPPPDQLPEVMNDMRLREDEPHANRGEEDKDMEPPIVNGCGTETGQVITTTVGGRDGKPKQTISYMAQRVVGTGSFGVVFQAKCLETGEQVAIKKVLQDKRYKNRELQIMRLQDHPNVVRLRHSFFSTTDKDELYLNLVLEFVPETVYRALKHYTKMNQHMPIILVQLYTYQICRALNYLHRVVGVCHRDIKPQNLLVNTHTHQLKICDFGSAKMLVPGEPNISYICSRYYRAPELIFGATEYTNAIDMWSGGCVMAELLLGQPLFPGESGIDQLVEIIKILGTPTREEIRCMNPNYTEFKFPQIKAHPWHKIFHKRMPPEAVDLVSRLLQYSPNLRCTALEACAHPFFDDLRAPNVSLPNGRALPPLFNFTAQELAGASTELRQRLIPAHCQGTGNSS

SEQ ID NO: 14238 - protein, 120 aa, Zea mays
  unsure (1)..(120): unsure at all Xaa locations
ALPRRQRRGGWTQDAPEMCRGGKNTILLHNPWEDSFPGALIILDRRFWGDLSARIQXKAEGEDKFRTLTRWPPREIPRLAPASPPGSPEKNALAKGRAMQKNSMRACGGLAPENCMMLKY

SEQ ID NO: 14239 - protein, 471 aa, Mastocarpus jardinii
SGVIPYAKMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRSVAASGEIKGHYLNITAATMEEMYERAEFAKQLGSIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADFVETPTANV

SEQ ID NO: 14240 - protein, 414 aa, Aquifex aeolicus VF5
MIEDPMDWAFPRIKRLPQYVFSLVNELKYKLRREGEDVVDLGMGNPNMPPAKHIIDKLCEVAQKPNVHGYSASRGIPRLRKAICNFYEERYGVKLDPEREAILTIGAKEGYSHLMLAMISPGDTVIVPNPTYPIHYYAPIIAGGEVHSIPLNFSDDQDHQEEFLRRLYEIVKTAMPKPKAVVISFPHNPTTITVEKDFFKEIVKFAKEHGLWIIHDFAYADIAFDGYKPPSILEIEGAKDVAVELYSMSKGFSMAGWRVAFVVGNEILIKNLAHLKSYLDYGIFTPIQVASIIALESPYEIVEKTAKVYQKRRDVLVEGLNRLGWKVKKPKATMFVWAKIPEWINMNSLDFSLFLLKEAKVAVSPGVGFGQYGEGYVRFALVENEHRIRQAIRGIRKAFRKLQKERKLEPERSA

SEQ ID NO: 14241 - protein, 573 aa, Streptomyces avermitilis MA-4680
MTTDRNKTAERDTTHKPLRVTARGRAVLADPRLNRGTAFTDEERRALGLVGLVPPRVLTQDEQADRAYAQFREQPGDLAKNVYLTALHDRNEVLFYRLVGDHLEEMLPIVYTPTVGTAIKRYSYEYRRPRGIYLSVNAPDDIERSLRAAGLGADDVDLIVATDGEGILGIGDWGVGGIDIAVGKLAVYTAAAGVDPRRTLPVMLDVGTNRQELLDSPLYLGNRHPRVDRDTYDAFIDAYVTAATKLFPRALLHWEDFGPANARRIFNHYRDDVFTFNDDIQGTGAVNLAAVLSGAKAGDLPLRDHRIVVLGAGSAGIGVADQLRDALVAEGLSSDEATARFWCVDRYGLLTADQGDKLRDFQVPYARPADEVSDWQRDDDLPGIPLDEVVRRVHPTILIGTSGQGGAFTETVVREMAAHTPRPIILPMSNPTDLAEAKPADLLAWTDGKALVATGSPFDPVELNGTTYRIGQANNALIFPGLGLGAIVARATRVTDRMLRAAADAVANQTDVTDPGAPVLPPVRDLRETSFAVAVAVARAAAEDDVARAGTDDIEAAVRAVTWEPVYPPVQAV

SEQ ID NO: 14242 - protein, 362 aa, Saccharum officinarum
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIIVECVLPVNTEAVPKAQGVFHVDMIMLAHNPGGRERYEREFHDLAKGAGFSGFKATYIYANAWAIEFIK

SEQ ID NO: 14243 - protein, 489 aa, Beta vulgaris
ITVPSTSSKNLQNSLAFSSSSLSGDKIQTTSFLNRRYCRISSRAPIVVSPKAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYERFVQAHRETDADITVAALPMDEKRATAFGLMKIDEEGRIIEFAEKPKGEQLKAMKVDTTILGLDDERAKEMPFIASMGIYVISKDVMLNLLREQFPGANDFGSEVIPGATSIGLRVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKFLAAKGSVPIGIGNARIGDDVKIINSDNVQEAARETDGYFIKSGIVTIIKDAMIPSGTVI

SEQ ID NO: 14244 - protein, 540 aa, Triticum aestivum
  unsure (1)..(540): unsure at all Xaa locations
MDPYKVCTPPILPQPTRSRQLAGPDRRFGCPCRPAIRSSDALGFPGFLCCSQHRPTSGANSGYWTTNSGAPVWNNNNALTVGQRGPILLEDYXLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDXTDSIAAGNYPEWKXFXXQTIDADHEDKFDFDPLDVTKTWPEDIIPLQPVGRMVLNKNIDNFFAENEQLAFCPAITVPGIHYSDDKLLQTTIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLASRLKIKPSM

SEQ ID NO: 14245 - protein, 275 aa, Vibrio vulnificus CMCP6
MTKWVLITGCSSGIGYVCAHALQKSGFEVIASCRNLRDVERLQSEGLTCIQLDLADSNSISLAVQQALEISDGQLYGLFNNGAYGQPGALEDLPTDALRAQFESNFFGWHQLVREILPIMRKNKQGRIVQNSSVLGFAAMKYRGAYNASKFAIEGWSDTLRLELDGTNIHIAILEPGPIETRFRYNALQAFLQCIDIENSPHRESYLAQKDRLENTNSKSSFVLPAESCIEPVLHALTSQKPKIRYRVTTPTKLFAVFKRILPTRWLDEILKRAA

SEQ ID NO: 14246 - protein, 199 aa, Pseudomonas syringae pv. syringae B728a
MLLMIDNYDSFTYNVVQYLGELGADVKVIRNDELSIAEIEALNPEHIVVSPGPCTPNEAGVSLDVIKHFAGKLPILGVCLGHQSIGQAFGGDVVRARQVMHGKTSPVIHQDGGVFDGLNHPLVVTRYHSLVVKQDTLPDCLEVTAWTALEDGSVDEIMGLRHKTLNVEGVQFHPESILTEQGHELFANFLKQSGGHRQG

SEQ ID NO: 14247 - protein, 172 aa, Brucella melitensis 16M
MKIGVVTVSDRASRGEYEDLSGPAIEAWLKGAIVTPYEIVRRVIPDGMESVRDTLIDLCDTVACDLILTTGGTGPSPRDETPEAMKAVLHKELPGFGEQMRRVSLEQTPTAVLSRQTAGSRGKSFILNLPGKPASIAMTLQAIFPAVPYCLDLIGAGRIDTDPSVVKAHRPG

SEQ ID NO: 14248 - protein, 279 aa, Pseudomonas syringae pv. tomato str. DC3000
MIKKCLFPAAGYGTRFLPATKAMPKEMLPVVNKPLIQYGVEEALAAGLTEISIVTGRGKRSLEDHFDISYELEHQIKGTDKEKYLVGIRKLIDECSFSYTRQTEMKGLGHAILSGRPLIGNEAFAVVLADDLCVNLEGDGVLAQMVKLHKHYGCSIIAIQEVDPSETNKYGVIAGEEIKPGLFRVTDMVEKPKPEDAPSNLAIIGRYILTPDIFEKIEQTEPGKGGEIQITDALMKQAAEGNVLAYKFKGTRFDCGGAEGYIEATNFCFEHFYKAGKAH

SEQ ID NO: 14249 - protein, 428 aa, Coxiella burnetii RSA 493
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 14250 - protein, 492 aa, Zantedeschia aethiopica
MDPYRQRPSSAFNSPFWTTNSGAPVWNNNNSLTVGARGPILLEDYHLLEKLAQFDRERIPERVVHARGASAKGFFEVTHDVSHLTCADFLRAPGVQTPVIVRFSTVIHERGSPETLRDPRGFAVKFYTREGNFDLVGNNFPVFFIRDGIKFPDMVHALKPNPKTHIQENWRILDFFSHHPESLHMFTFLFDDIGIPTDYRHMDGSGVHTYTLVSKEGKAHYVKFHWKPTCGVKSLLDDEAVVVGGANHSHATKDLTDAIAAGNYPEWKLYIQIMDPDHEDRFDFDPLDVTKTWPEDILPLQPVGRMVLNKNIDNFFAENEQLAFCPAIIVPGIYYSDDKLLQTRIFSYADTQRHRLGPNYLMLPANAPKCAHHNNHHEGFMNFMHRDEEVNYFPSRYDPVRHAEQFPIPPRILNGGREKCCIQKENNFKQPGEKYRSWAPDRQERFIKRWIDALSDPRVTHEIRTIWITYWSQCDKFLGQKLASRLNIKPTL

SEQ ID NO: 14251 - protein, 515 aa, Oryza sativa (japonica cultivar-group)
MATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPYWRALRRVAAGHLFGPRQVDAFAPYRARVAGGVVAALRGAGGEAAVQVRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 14252 - protein, 153 aa, Glycine max
MATFPTLHGLHNPLPRSQFLGQDHPLTHQFPLKQQVHHKTAPTHEVLMPRAAKFNILEMMGGRGLCNGEKGLQQELKRQVVVPQSSISSQEEEAPSGEKEEQEGEGGDDDEGSVKVPEDGFEKEMMGLTGGFPGGEKGLKKFIEKKQPSYKSN

SEQ ID NO: 14253 - protein, 273 aa, Helicobacter pylori J99
MIKKCLFPAAGYGTRFLPITKTIPKEMLPIVDKPLIQYAVEEAMEAGCEVMAIVTGRNKRSLEDYFDTSYEIEHQIQGTNKENALKSIRNIIEKCCFSYVRQKQMKGLGHAILTGEALIGNEPFAVILADDLCISHEYPSVLKQMTSLYQKYQCSIVAIEEVVLEEVSKYGVIRGEWLEERVYEIKDMVEKPSQEDAPSNLAVIGRYILTPDIFDILRETKPGKNNEIQITDALLTQAKRKRIIAYQFKGKRYDCGSVEGYIEASNAYYKKRL

SEQ ID NO: 14254 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 14255 - protein, 256 aa, Agrobacterium tumefaciens str. C58
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 14256 - protein, 332 aa, Streptomyces aureofaciens
MTRIAINGFGRIGRNVLRALLERDSDLDVVAVNDLTEPATLARLLAYDTTSGRLGRPVTVEGNVLVVDGRRITVTAEREPANLPWAELGVDIVLEATGRFTSAKAARAHLDAGAKKVLVSAPADGADITLAFGVNTDAYDPDLHTIVSNASCTTNALAPLAKVLDDLAGIEHGFMTTVHAYTQEQNLQDGPHRDPRRARAAAVNIVPTTTGAAKAIGLVLPNLDGKLSGDSIRVPVPVGSIVELNTTVARDVTRDEVLDAYRAAAQGPLAGVLEYSEDPLVSSDITGNPASSIFDSELTRVDGRHIKVVAWYDNEWGFSNRVIDTLQLLAAR

SEQ ID NO: 14257 - protein, 151 aa, Picea abies
MAMDPLLSTVQQLLGVPDDLERILHAPTRSYMRDTEATASTPVDVKEYPNSYVFIVDMPGLKSNDIKVQVEDENVLNISGERKRNEKEEGEVKYIRMERRVAKFMRKFSLPADCNLEAISAACQDGVLTVTVPKLPPPEPKKPKTIAVKIG

SEQ ID NO: 14258 - protein, 442 aa, Oryza sativa
  unsure (1)..(442): unsure at all Xaa locations
MEEAAAEVPSYFLCPISLEIMRDPVTLATGITYDRSSIERWMFGGGGGDGGKGTCPVTRRQLAPAEREATPNHTLRRLIQAWCAAHAVERFPTPRPPVDSCRVAALVDEGTTTMLGGGGRQRQLAALREIKAIAAESDRNKRCVEATPGAVEFLVSVVVQSHAAASTSASSDDDDLFDSVIDSPMSTSSPEEEALGVLYSLKPSEPTLRRVLGKDNGVGFLDTLASVLRRPSYRSRAYAILLLKAVTSAMPPERLMAVSPELVEEVVRVVSDGVSSKAVKAALHVLCRLCPWGRNRVKAVEAGAVAALVELLLDEEGGGGRRRAAELAVVAIDHPVRVRGGEVGAGGAPGGARRGVQXAMRVSPAATESAVRALHAVARNAATPAVLQEMLAVGVVAKLLLVLQADGGERARARAREMLRANARVWKDSPCLQAHLKASYPS

SEQ ID NO: 14259 - protein, 595 aa, Oryza sativa; identical to SEQ ID NO: 8787

SEQ ID NO: 14260 - protein, 281 aa, Pisum sativum
MASATSSLCSSTLQSQINGLSLRKTSLLHSPSLTFSRRKFSTVVKASSRVDKFSKSDIIVSPSILSANFAKLGEQVKAVELAGCDWIHIDVMDGRFVPNITIGPLVVDALRPVTDLPLDVHLMIVEPDQRVPDFIKAGADIISVHCEQSSTIHLHRAVNQVKSLGAKAGVVLNPGTPLSAIEYVLDVVDLVLIMSVNPGFGGQSFIESHVKKIAELRRLCVEKGVNPWIEVDGGVTPANAYKVIEAGANALVAGSAVFGAKDYAEAIKGIKASKRPEPVAV

SEQ ID NO: 14261 - protein, 355 aa, Cryphonectria parasitica
MGACMSSSSEETEQKKRSQKIDKDLEEDSKRLRRECKILLLGSGESGKSTIVKQMKIIHLKGYSDEELYNYRPTVFKNLIECAKAVVNAMRQFDIEPEKEETKTLCDFLLEYSVDSGPQVLIDTRVGEAIQAIWNDPARKQLMDRQTEFYLMDSAEYFFEQAQRIVRQDYLPNEMDVLRARTKTTGIYETRFQMGQLSIHMFDVGGQRSERKKWIHCFENVTSIIFCVALSEYDQVLLEESSQNRMMESLLLFDSVVNSRWFVRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 14262 - protein, 226 aa, Triticum aestivum
MSVVATAAAAVGPAPMAPSGMCGGGAGGGGARKRKDVVHYQEEEEEVVAAVQGGRLGGEGHGLFVLETVEEEEEREAEAAAEAENERSSIGPVSEGDEEEGEEVESARETPWQRRTKKTGGLASLDALDDALPIKRGLSSFFSGKSRSFANLQDVAGAGTTSSKDVLAKPENPFNKRRRILRCCSIRRVSSTSLTALPPFLPPEPSFNIGNDGVINGGGGGSGGSG

SEQ ID NO: 14263 - protein, 469 aa, Bangia sp.
VIRYAKMGYWDADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMNMFGRPFLGATVKPKLGLSGKNYGRVVYEGLKGGLDFLKDDENINSQPFMRWRERYLYSMEGVNKATAASGEVKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESDTPLNLPQGLFFAQDWASLRKVVPVASGGIHAGQMHQLLDYLGDDVVLQFGGGTIGHPDGIQAGATANRVALESMVMARNEGRDYVSEGPQILRDAAKTCGPLQTALDLWKDISFNYTSTDTADFVETPTANV

SEQ ID NO: 14264 - protein, 453 aa, Zea mays
MTTTTKQLRRVRTLGRGASGAVVWLGSDEASGELVAVKSARAAGAAAQLQREGRVLRGLSSPHIVPCLGSRAAAGGEYQLLLEFAPGGSLADEAARSGGGRLAERAIGAYAGDVARGLAYLHGRSLVHGDVKARNVVIGGDGRARLTDFGCARPAGGSTRPVGGTPAFMAPEVARGQEQGPAADVWALGCMVVELATGRAPWSDVDEDDLLAALHRIGYTDDVPEVPAWLSAEAKDFLAGCFERRAAARPTAAQLAAHPFVVASAAACAAIRGPAKQEVVPSPKSTLHDAFWDSDAEDEADEMSTGAAAERIGALACAASALPDWDTEEGWIDLQDDHSAGTADAPPAPVADDFISWAEPSDAELEPFVAVAAAAGLPHVAGVALAGATAVNLQGSYYPPMHLGVRGNEIPRPLLDHHGDALEKGQGSHRTCNRETEKVTMKRISLKKKKKKK

SEQ ID NO: 14265 - protein, 360 aa, Schedonorus arundinaceus
MGSTAADMAASADEEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 14266 - protein, 716 aa, Pseudomonas syringae pv. syringae B728a
MASKNAPPVTETPKSEMAGTDTLDRGNTNEKLESLEQFRSDATQQALRTNHGVKISDNQNTLKVGSRGPSLLEDFIMREKITHFDHERIPERIVHARGTAAHGYFQTYEDHGALSKAGFLRDPGKKTPVFVRFSTVQGPRGSGDTVRDVRGFAVKLYTDEGNFDLVGNNMPVFFIQDAIKFPDFVHAVKPEPHNEIPTGGSAHDTFWDFVSLVPESAHMVLWTMSDRAIPKSLRTMQGFGIHTFRFINTEGKSSFVKFHWKPKFGVCSLVWDEAQKLAGKDTDFHRRDLWESIEMGDYPEWELGVQIVAEEDEHKFDFDLLDPTKIIPEELVPVTPLGKMVLNRNPDNYFAETEQVAFCPGHIVPGIDFSNDPLLQGRLFSYTDTQISRLGGPNFHEIPINRPIAPNHNGQRDAQHRTTIDKGRASYEPNSIDGGWPKETPAGPVDGGFETYPERVEAHKVRERSESFGDHFSQATLFFQSMSHHEKEHIIAAYSFELGKVEREYIRARQVNEILANIDMDLAKRVAANLGLPAPAAGTVPARQTSVKESPALSQVNLLSGDIVSRKVAILVADGVDGKAVEAMKAALTAEGAHAKVLGPTSAPVKTADGKSLPVDASAEGLPSVAFDAVFVPGGKASIEALKGDGVALHFILEAYKHLKAISFAGEAKELLSLLRLEEDAGLLEVSDSTSFKPFFHAIAQHRVWDREAKAKAVPA

SEQ ID NO: 14267 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 14268 - protein, 533 aa, Oryza sativa
MVGARMVRLRLYERGRVAARDGVSGGTADQRVESPRVRYGDGEIESEYRYDTTEVVAPPSPEKGWVVRPKSVTYHFKTTTTVPKLGVMLVGWGGNNGTTLTAGVIANREGISWATKEKVHKANYFGSLTQSSTIRVGSYNGEEIYAPFKSLVPMVNPNDIVFGGWDISSMNLADAMTRARVLDIDLQKQLRHHMESMVPLPGVYNPDFIAANQGSRANNVIKGTKKEQVEQVKKDIREFKEKSKVDKVVVLWTANTERYSNVVAGMNDTMDNLLASLDKDEPEMSPSTLYAIACVMEGVPFINGSPQNTFVPGLIELAIKKNSVIGGDDFKSGQTKMKSVLVDFLVGAGIKPTSIASYNHLGNNDGMNLSAPQTFRSKEISKSGVVDDMVSSNAILYEPGEHPDHVIVIKYIPYVGDSKRAMDEYTSEIFMGGKNTIVLHNTCEDSLLAAPIILDLVLLAELSTRIQLKAEDQDKYHSFHPVATILSYLSKAPLVPPGTPVVNALAKQRAMLENILRACVGLAPENNMMLEYK

SEQ ID NO: 14269 - protein, 374 aa, Triticum aestivum
  unsure (1)..(374): unsure at all Xaa locations
GYKSCLQGQTDVMSLTQGIVYWQTPEIALHKVKVTVWEPAXSKYAADDGLPELREALLEKLRRENKLTKSSVMVTAGANQAFVNLVLTLCDAGDSVVMFAPYYFNSFMSFQMTGVTDILVGASNPKTLHPDVDWLEKVLKENNPIPKLVTVVNPGNPSGAFIPKPMLQRISDLCRNAGAWLVVDNTYEYFMYDKMEHYCLEDDHIVNLFSFSKAYGMMGWRVGYIAYPSEADGFHAQLLKVQDNIPICASIIGQRLALYSLEAGPEWIRERVNDLVKNRELLVEAMSPLGEDAVKGGEGAIYLWAKLPDNCSDDFEVVRWLATKHGVAVIPGSASGGPGYIRVSFGGLKEEDTRLAGERLRRGLQELVTDGMVQ

SEQ ID NO: 14270 - protein, 660 aa, Lactobacillus plantarum WCFS1
MSKQAQFNKHRVAGLLVAMGVVYGDIGTSPLYVMKAIITGQGGMQAVDEKFMLGAVSLVFWTMTLLTTVKYVLIALNADNHGEGGIFSLFALVRHRARWLVIPAMIGGAALLADGALTPAVTVTTAIEGLRDVPAYVQLFGASQNTIILITLGIITLLFMLQRFGTNTIGKLFGPIMLGWFTFLGVSGFVNLVQDWTILRALNPYYAWLLLISPANKVGILILGSVFLATTGAEALYSDLGHVGKTNIRLSWPYVKVCLLLSYFGQAAWILGPGQAIQGHVNPFFAMLPASLTMAAVIFATLAAIIASQSLISGSFTLVSEAIRLKLFPRLLTTYPGKAVGQMYLPVVNWGLWGVTSMLVIFFQTSERMEAAYGLAITLTMLMTTTLIYAFLRQKRLPLIGAGLLTGFFATIEVIFLIASAAKFWHGGYVAVGLALLIFLVMAVWYRGEQIVRQHNHPLSLRQYQDQLAKLRDDQTVDKFQTNVVFLTSRMDGDQVERKVLYSILDKWPKRADVYWFVNVTITDEPYTAEYTVDTLATDYLVTVKLYLGFRVRQDINRYLRTIVRDLMATGRLAAQKQTYSVTSGRDVGDFRFVIIEEKLENGSRLSRLDRLVIETKLMIKKYATTPAKWFGLEFSEVTLETVPILFNEIPALPITERQR

SEQ ID NO: 14271 - protein, 427 aa, Lemanea fucina var. parva
IEASAAIAGESSTATWTVVWTDLLTACDLYRAKAYKVDAVPNTSDQYFAYIAYDIDLFEEGSISNLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSIEGVNRAQAAAGEIKGHYLNVTAATMEDMYERAEFAKQLGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDFVTEGPQILRDAAKTCGPLQTALDLWKDISFNYTSTDTADFV

SEQ ID NO: 14272 - protein, 241 aa, Asparagus officinalis
MGRGRVELKRIENKINRQVTFSKRRNGLLKKAYELSVLCDAEVALIIFSSRGKLYEFGSAGTSKTLERYQRCCYTSQDAAIASHETQSWYQEVSKLKAKFESLQRSQRHLLGEDLGPLSVKELQQLERQLESALSQARQRKTQIMLDQMEELRKKERHLGEINKQLKAKLEAEGASFRAIQGSWESEAGVGGNAFSMHPSQSSAMDCEPTLQIGYHHLVQPEAALPRSSGGENNFMLGWVL

SEQ ID NO: 14273 - protein, 178 aa, Glycine max
MASSMISSPAVTTVNRAGAGMVAPFTGLKSMAGFPTRKTNNDITSIASNGGRVQCMHVWPPIGKKKFETLFYLADPDDAQLAKEGEYPLKKGWIPCLEIQVEHRFVYREHNRAPRYYHGRLWTMWKLAMFGCTDASQGVKELQEAKTAYPNGFIRIIGFDNVRQVQWINFIGYKPPGF

SEQ ID NO: 14274 - protein, 162 aa, Triticum aestivum
  unsure (1)..(162): unsure at all Xaa locations
MAPSVMASSATTVAPFQGLKSTAGMPVARRSGNSSFGNVSNGGRIRCMQVWPIEGIKXFETLSYLPPLTVEDXLKAVXVPAPSNWVPCPDSSKGPVCPTVENHRXPGYYQRKYWTIWNCQGSVDRXTQXLKDPRRQKGSPILTVKLKLFNPKTPGSGEKPQK

SEQ ID NO: 14275 - protein, 459 aa, Zea mays
  unsure (1)..(459): unsure at all Xaa locations
MATHAALAASRIPAGARLXHSRAAASSRHGVQRLDFADFSGLRPGSCSVSAAAREASFSDVLGAQLVAKVRMRFMDDATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPXGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 14276 - protein, 172 aa, Streptococcus agalactiae 2603V/R
MDLNNYIASIENYPQEGITFRDISPLMADGKAYSYAVREIVQYAADKDIDMIVGPEARGFIVGCPVAYALGIGFAPVRKPGKLPREVISADYEKEYGLDTLTMHADAIKPGQRVLIVDDLLATGGTVKATIEMIEKLGGVVAGCAFLVELDGLNGRKAIEGYDTKVLMNFPG

SEQ ID NO: 14277 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNAPCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 14278 - protein, 86 aa, Glycine max
EFLEGLPLGLSPKSPNLIPKSRCGAFAFSLTSMADSVISIQYLKDFVNSQIYDDEKWAFNAKLLRAAGLFAGSILLMRNYGDLMAI

SEQ ID NO: 14279 - protein, 418 aa, Nicotiana tabacum
AADGYARARGVGACVVTFTVGGLSVLNAIAGAYSENLPLICIVGGPNSNDYGTNRILHHTIGLQDFSQEPRCFQTVTCYRAVVNNLEDAHELIDTAVSTALKESKPVYISIGCNLPGIPHPTFSREPVPFALSPRLSNMMGLEAAVEAAAEFLNKAVKPVLVGGPKMRVAKASDAFVELSDACGYAVAVMPSAKGLFPEHHSHFIGTYWGAVSTAFCAEIVESADAYLFAGPIFNDYSSVGYSLLLKKEKAIIVQPDRVTIGNGPAFGCVLMRDFLAALAKRLKHNPTAFENYHRIYVPEGHPLKCEPKEALRVNVLFQHIQNMLSGDSVVIAETGDSWFNCQKLKLPKGCGYEFQMQYGSIGWSVGATLGYAQAAPEKRVIACIGDGSFQVTAQDISTMLRCGQRTIIFLINNGGYT

SEQ ID NO: 14280 - protein, 339 aa, Haemophilus somnus 2336
MNKNIDWENLGFSYIKTDYRYIAYWKNGAWSKGELIQDNVLHISEGSTALHYGQQCFEGLKAYRCKDGSINLFRPEQNALRMQKSCQRLLMPEIPVEMFVDACKQVVKANADWLGPYGSGATLYLRPFLIGVGDNIGVSPAPEYIFSIFCCPVGAYFKGGMKPTNFIVSDYDRAAPQGTGAAKVGGNYAASLYPGKMAKTRHFADCIYLDPTTHKKIEEVGSANFFGITKDNKFITPLSPSILPSITKYSLLYLAKERLGMEVIEGDVYIDQLDQFKEAGACGTAAVITPIGGIQYGDHFHVFYSETDVGEITTKLYNELVGIQFGDVDAPKGWIVKVE

SEQ ID NO: 14281 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 14282 - protein, 212 aa, Streptococcus pneumoniae TIGR4
MQNRPIIIGVTGGSGGGKTSVSRAILSHFPDEKISMIEHDSYYKDQSHLTFEERVKTNYDHPFAFDTDLMIEQIKELLAGRPVDIPTYDYTEHTRSSKTYRQEPQDVFIVEGILVLEDKRLRDLMDIKIFVDTDDDVRIIRRIKRDMEERGRSLDSVINQYLGVVKPMYHQFIESTKRYADIVIPEGVSNTVAIDLLTTKIAKILEEARNSK

SEQ ID NO: 14283 - protein, 222 aa, Oryza sativa
MAAAAVVPIALGPGAGGGPGRREAPAGAHGAAASSRPAPLPGLPSRLNLPSTVLLVCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQR

SEQ ID NO: 14284 - protein, 304 aa, Actinobacillus pleuropneumoniae serovar 1 str. 4074
MIELNGEPFGQMRQTYGGDTLNTATYLARVSTPEQIQVCYVSALGTDKLSQGMLAYWQADGIDTQWVLKDEQRSPGLYLIQLDKKGERTFLYWRNQSAARYLLQHSNFPQVLSELDSVDMIYLSGISLAILPENDRKLLITSLAKLKQAGVEIAFDSNFRPKLWESLEQAQACYRELLPLVDVALVTFDDEAMLWQDEDEQQTIARLSAYGIAKIIVKQGSRGAVVCEHLQQTFVPTIPVEHVVDTTSAGDSFNAGFLAGYLQGKPLAVCCRQGNQLAGIVIQHKGAIIDKSATAHLFAQFNAM

SEQ ID NO: 14285 - protein, 188 aa, Pyrococcus furiosus DSM 3638
MILIINNRDSFVWNLAEYVSFFDEAVVVSNKITLSEVKKLDPDGIIISPGPGHPLDRREVGNSPEIVLESEVPLLGVCLGHQIIGAVFGGKIGRVTPKHGKASLIRHDGKGVYRGLDNPFLAGRYHSLAVLEPPKGFKVTSVSLDDGVIMGIRHKTLPIEGVQFHPESVLTKREDGLRIIQNFVEMTR

SEQ ID NO: 14286 - protein, 457 aa, Staphylococcus xylosus
AGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 14287 - protein, 330 aa, Enterococcus faecalis V583
MKMKALKKSGLSKEELIQAYREVLRGRRLDERLWQLTRIGKTSFNISGQGAEVAQVAMAMAFDPQKDYFLPYYRDMTACLVWGMTSKDILMGSFGKEADPSSHGRQMPNHYGSKEHNIVSFSSTVSTQMPLATGVGYAAQLQKADFVALTTTGEGSANQGEVQEAMNFAGVKKLPVIFVVENNEYAISVPIEEQYANKRMADRAKAYGFEGVTVDGSDFTEVYLAFKEAVKAARGKKGPKLIELMVSRLTSHSADDDQSVYRSKEEIEEMKKNDAVKLFEKQLLEEGYLTDEDIAKIDEEIRAEINQATDEAEAMPDPVPTSILEEVYAK

SEQ ID NO: 14288 - protein, 164 aa, Zea mays
AKVLCTSPCFYVTIYINITNKVLLDQFFDHAIGINVPRSRFLPVKATSDLKLVQSDLYTLVDGFVTRNSARTNPSNPSIELGPEFKKVGSFLGRFKSIPSIVELDILKVSGDVWFGSGIVLKGKVTITAKPGVKLEILDGAVIGNKDNFGKGKRKQYQMPYNLN

SEQ ID NO: 14289 - protein, 501 aa, Saccharomyces cerevisiae
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNIIHELPPTNQVLSLHTMLLNKNLNCADFVFYFDRLATILLSWALDDIPVAHTNIITPGEHTMENVIACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFFDSKYFGCD

SEQ ID NO: 14290 - protein, 434 aa, Fusobacterium nucleatum subsp. nucleatum ATCC 25586 [sequence omitted]

SEQ ID NO: 14291 - protein, 351 aa, Oryza sativa
MALEAVLLSRGDLFGRRRCAMEGGGGGWSSPFSGFEGVMDLDGGNWDAAACSSMLLHGFQELEIPAAAAAAAAMAPPPPPVEPANCAENAGGVGGHQEDQAAVAAAATAVQSGRRKRRRARAAKNKEEVESQRMTHIAVERNRRKQMNEYLAVLRSLMPPSYAQRGDQASIVGGAINFVKELEQLLQSLEARKSSRQCAAHDAAAAAAPFASFFTFPQYSMSAAAAAAPVAPVVNELHGRDDGGAGTAEAEASGSKPSAVADVEVTMVESHANLRVLSRRRPRQLLRLVVALQGHRLTVLHLNMTSAGHMVLYSFSLKVEDDCQLTSVDEIATAAHQIIEKIQEEQGCSLD

SEQ ID NO: 14292 - protein, 103 aa, Glycine max
  unsure (1)..(103): unsure at all Xaa locations
FIHVNNNVGMNPSALDTCGFDELAKTDLVFDVGYSNAMLYEPEEHTEHVAVIQYGRNVWNIHKAVVECTVEMFLGGXNASIWINIGEESLNGAPIMRDYGLLA

SEQ ID NO: 14293 - protein, 496 aa, Zea mays
  unsure (1)..(496): unsure at all Xaa locations
GYLEAGRDFYSTFGEKKRLGAVALPPSLSSPAASPTAQPHRGERDRYRERETKRTRERGRSFPRRLRPQPAAPPPTTSAAMPGGAHGAGAADPMQVDQPLPPAAAGTAHAPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKMDLLCXQVLGTPTREEIRCMNPNYTEFRFPQIKAHPWHKIFHKRMPPEAIDLASRLLQYSPNLRCTALEACAHPFFDDLREPHARLPNGRPFPPLFNFKQELANASPELINRLIPDHARRHLGLTLLPATGP

SEQ ID NO: 14294 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 14295 - protein, 661 aa, ASPERGILLUS NIDULANS FGSC A4
MATSYDATTTASELADHLSADIKGKVVLTTGPSPASIGAMFVESIARGLPALIILAGRSTTKLQQTAGAIAQAQPVVKVRLLHLDLGSLASVREAARELASWEDVPRIDVLVNNAGIMGTKFALSPEGVESQFTTNHLGHFLLTNLIIGKILKSDTPRVVNVSSDGHRLSPIRWADYNFQEGEIYNKWLAYGQSKTANMLMAVSLAEKLGSRGLLAFSLHPGVIISTSISGGLDNMDEDLAALKALDRMLGNAEGWRDFKVKTRQQGAATTVYAAFYPGLKESNGAYLQDCHVADPWTDTVKPWGTDKVEAERLWKLSEKLSMEWTVEAGLLAGGYGKSLQMCIQKPKTGDHYFHFVIYGENQLVPGNNTIRIPSVRMTMADDITHFRSIPWVSDLLNDPTFVTHPIPSRKIKASTEDSLFSTTLNSRSTISSCLLQYRILSSNATPLYRNAIPTNEVRIFCTLGSDLNGYPGILHGGIVATLLDEFMGLILSMSRAGGEPGMEGPVTAYLNTRFVRPVMTPGTVVVSGRIVEAKEERKWKIVGNIKDTSNKTSPAWPQYMPRISHATALLLSTATESFLKVELQMPALLILALALLLVCLSNMIGSYSSFAAAATFHLDSGIYFSGIGFEQPCFGNAGNCLERALGKGKPRGLKKNLGLI

SEQ ID NO: 14296 - protein, 411 aa, Pseudomonas fluorescens PfO-1
MTQAYEPLRLHVPEPSGRPGCKTDFSYLHLTDAGTVRKPSIDVEPADTADLARGLIRVLDDQGNALGPWAENVPVEILRKGMRAMLKTRIYDNRMVVAQRQKKMSFYMQSLGEEAIGSAQALALNIDDMCFPTYRQQSILMARDVPLVDLICQLLSNERDPLKGRQLPIMYSVKDAGFFTISGNLATQFIQGVGWGMASAIKGDTKIASAWIGDGATAESDFHTALTFAHVYRAPVILNVVNNQWAISTFQAIAGGEATTFAGRGVGCGIASLRVDGNDFYAVYAASAWAAERARRNLGPTMIEWVTYRAGPHSTSDDPSKYRPADDWSHFPLGDPIARLKQHLIKVGHWSEEEHAAVSAELEAEVIAAQKQAEQYGTLAGGQIPSAATMFEDVYKEMPEHLKRQRQQLGI

SEQ ID NO: 14297 - protein, 519 aa, Oryza sativa; identical to SEQ ID NO: 6433

SEQ ID NO: 14298 - protein, 519 aa, Zea mays
  unsure (1)..(519): unsure at all Xaa locations
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTRISNCIIDMXCQGWKERLHNKQRGRPRSRPAGRRILXIRSGIVVVLKNATIKDGTVI

SEQ ID NO: 14299 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIRADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDVDRNNSSRINLQDICKDLNQEGDDQMFVRKTSKEIQGQNRRNLIHEDIAKAIRQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKSGII

SEQ ID NO: 14300 - protein, 477 aa, Streptococcus thermophilus
SNLATGLVTATDEGDPVLAIGGQVKRADLLKRAHQSMNNVAMLEPITKYAAEVHDANTLSETVANAYRHAKSGKPGASFISIPQDVTDAPVSVKAIKPMTDPKLGSASVSDINYLAQAIKNAVLPVFLLGNGASSEAVTYSIRQILKHVKLPVVETFQGAGIVSRDLEEDTFFGRVGLFRNQPGDMLLKKSDLVIAIGYDPIEYEARNWNAEISARIIVIDVEPAEVDTYFQPERELIGNVEASLNLLLPAIQGYKLPEGSVEYLKGLKNNVVEDVKFDRQPDEGTVHPLDLIEVLQEQTDDDMTVTVDVGSHYIWMARYFKSYEPRHLLFSNGMQTLGVALPWAISAALVRPKTKVISVSGDGGFLFSAQELETAVRLKLPIVHIIWNDGHYNMVEFQEEMKYGRSSGVDFGPVDFVKYAESFGAKGYRATSKAAFASLLQEALTQAVDGPVLIDVPIDYKDNIKLGETILPDEFY

SEQ ID NO: 14301 - protein, 396 aa, Zea mays
  unsure (1)..(396): unsure at all Xaa locations
KLELPAVAAALLRRIPAARAPATAFMAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLFXHDLATAAELKDMEKEIRKQVDDAIAKAXKESSMPDTSELFTNVYKKGFNVESFGPDRKELRATLP

SEQ ID NO: 14302 - protein, 293 aa, Magnetococcus sp. MC-1
MMKVRKAVFPVAGLGTRFLPATKVVPKEMLSVVDTPLIQYAVEEAWDAGIEEVILITGRGKSLLMDQFDHMYELEDTLRRQGKEVLLSVSHEPIPFPGTVVATRQQDPLGLGHAVWCARYLVGDEPFAVILPDDLVHAQKPVLKQMVERFEELQSSIVAVMEVAPDQTNKYGILDSEPEQNGVWRIKGLVEKPDPSVSPSNLAIIGRYILTPEIFCLLESIPRGAGGEIQLTDAMAALLKHQSIYGMRFEGTRFDCGDKAGFQMASLALSMERPELKDQMLAFIQENLPKWQA

SEQ ID NO: 14303 - protein, 199 aa, Oryza sativa
  unsure (1)..(199): unsure at all Xaa locations
SNFFYTYQFNNVNGRLFTLRTKGLNNVFYWGAQMLGSAAIGYFLDFGFGSSSRRRRGLCGVAAVAVLGTAIWAGGLANQLRYADGNWGERLIDFKDGRRYAGPFLLYFSYGGRAAGGQRGPXRTPGAPAGDTQGPSREGGVQEGVQSAGAAVAWQVDTHKTXLISQLIVNWALTTVSYPLLALLVLLSCEGGGQFCFFC

SEQ ID NO: 14304 - protein, 391 aa, Lycopersicon esculentum
MALSTSRAINHIMKPLSRAVCATRRLSSDSTATITVETSLPFTSHNVDPPSRSVETSPMELMTFFKDMTEMRRMEIAADSLYKAKLIRGFCHLYDGQEAVAVGMEAAITKKDCIITAYRDHCIFLGRGGTLVESFAELMGRRDGCSRGKGGSMHFYKKESGFYGGHGIVGAQVPLGIGLAFAQKYKKEDYVTFAMYGDGAANQGQLFEALNMAALWDLPAILVCENNHYGMGTAEWRAAKSPAYYKRGDYVPGLRVDGMDVFAVKQACAFAKQHALKNGPIILEMDTYRYHGHSMSDPGSTYRTRDEISGVRQERDPVERIRSLILAHNIATEAELKDIEKENRKVVDEAIRKAKESPMPDPSELFTNVYVKGFGVEAYGADRKELRATLP

SEQ ID NO: 14305 - protein, 190 aa, Prunus armeniaca
GFFEVTQDVPQLTCADFLRAPGVQTPVIVRFSTVIHERGSPETLRDPRGSAVKFYTREGNFDLVGNNFPVFFVRDAMKFPDAIRAFKPNPKSHIQETWRILDFFSHLPESLHTFAFFYDDLGIPQDYRHMEGSSVHAYTLVSKAGKVHYVKFHWKPTCGVKCLLEDEAIKVGGANHSHATKDLYDSIAAG

SEQ ID NO: 14306 - protein, 106 aa, Zea mays
  unsure (1)..(106): unsure at all Xaa locations
RNLFGPPDQRDPTGRHGSILRTQTRLSGQQSPDDWTTNXSDAPVWNNNXVLTVRQRGPILVEDHHLIQKLPQIHRERIPEQGAHARRASDNGSFEDTHDVYHLTCA

SEQ ID NO: 14307 - protein, 713 aa, Bacillus circulans
MKKFLKSTAALALGLSLTFGLFSPAQAAPDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 14308 - protein, 683 aa, Glycine max
MTCCFFFLQISLSLLSLLSIYSNCANLVGCSYSKEALDVSAKLLEVNPECYAAWNYRKLAVQHLLSNSDSDPHSIFDDELKLVEIALRKNFKSYGAWHHRKWVLNKGHSSIDNEMRLLNGFQKMDPRNFHAWNYRRFVAELMKRSDEDELKYTEEVIATNFSNYSAWHNRSVLLSNLLKRKAEGYFPKEKVLEEEFEHVHNAIFTDPDDQSGWFYHLWLIQQTVKIDAPLLVSSWPSHGSNITLIGDNDLRGCGLSLLNGTLSNPGTLPIILYFNQAVEGINSSTVAIKSELLKEELVWKPLSMNNSNTAQNWVVYLNLANLELQLSKTYSVEINIGHSKGIISSNGNHFGDPSQISFKVFVQTSYTELTEGQGGKRTTWMDTNFQKIDHFQESDSILPADQNHHIPTTSNRCAEEIGEEITKVRDLLSEYDCKIGKLTLARLLSALDSLSFQYDGRKSNTEEVLQLYTDLMKLDPTHSLYYKDEHSLISLKRITSTRDSLLPYCHYYKDATETVSGYVCLRLQNLSLSRMGSIENLLWVQMLDLSHNELQSIEGLEAMQLLSCLNLSHNKFGSFTALGPVRLLKSLKVLNISYNELGSHSIDTTRYLCSSPVSHTEEFAWDRFEILTGSINATKFWEAFLIFGSLTLTELNITGNAVADENFRSFLVKVLPTLRWLDDEELS

SEQ ID NO: 14309 - protein, 205 aa, Kluyveromyces lactis
MDTETEAEKQERHNNYLNELAEQDRWLPINNVARLMKNTLPATTKVSKDAKECMQECVSEFISFVTSEACDRCTSGKRKTINGEDILLSLHALGFENYAEVLKIYLAKYRQQQAIKNQMMYPKEDVEGSYTEEESRAEDADHVTQERQQPLHPVPSSASTTTSTEVSASEHVQSSSKSTHNPAQAQPRIVVQQPLGSRHSTADHL

SEQ ID NO: 14310 - protein, 128 aa, Coccidioides posadasii
MGADDKANHSTYRYNEVPVYTTSQGCPVMDPESSQRIGENGPLLLQDFHLIDLLAHFDRERIPERVVHAKGAGAHGEFEVTDDISDITTIDMLKGVGKKTKLVTRFSTVGGEKGSADSARDPRGFAVK

SEQ ID NO: 14311 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 14312 - protein, 353 aa, Oryza sativa
  unsure (1)..(353): unsure at all Xaa locations
MSCDYVRDYEFVAIFDADFQPNPDFLKLTVPHFKGNPELGLVQARWSFVNKDENLLTRLQNINLCFHFEVEQQVNGVYLSFFGFNGTAGVWRIKALEDSGGWMERTTVEDMDIAVRAHLNGWKFIFLNDVKVLCELPESYQAYRKQQHRWHSGPMQLFRLCLPAVFKSKQISTWKKANLVMLFFLLRKLILPFYSFTLFCVILPLTMFVPEAELPIWVICYVPVIMSVLNILPAPKSFPFVIPYLLFENTMSVTKFNAMVSGLFQLGSSYEWVVTKKAGRTSSESDILALAEEEQXAKAPNRIFKKELALAFLLLTAATRSLLSAQGLHFYFLLFQGVTFLAVGLDLIGEQVS

SEQ ID NO: 14313 - protein, 251 aa, Triticum aestivum
TLFLSLLLLSLSLSISCRTAEEWRTRSIYQIITDRFARTDKEATPCSDLGNYCGGTFKGIENNLDYIQGMGFDAIWISPVVANTPGGYHGYWVSNLYTINEEFGTEEELHQLIEACHARDIWVMVDVVANHIGYVQNLDFSAIVPFNDIAYFNEDKDCAPFFEIMDQDGIETCWLSGLPDLNQNHPFVKSTLIAWIKEFVQKHKFDALRIDTIAHVPKQFWHEFSKAAGVYTIGEALNHNMHYISQYQGPL

SEQ ID NO: 14314 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALSALKADHEFLLRGGVFSKDWIDSYIAFKEEDVRRIRMAPHPLEFEM

SEQ ID NO: 14315 - protein, 194 aa, Escherichia coli
MSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 14316 - protein, 488 aa, Tribonema intermixum
MSKNVQERTRIKSERYESGVIPYAKMGYWDADYNVKHTDILALFRITPQPGVDPVEAAAAVAGESSTATWTVVWTDLLTACDIYRAKAYRVDPVPGTTDQFFAYISYQCELFEEGSIANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCVEGINRSAAATGEVKGSYLNVTAATMEDMYERAEYAKNLGSIIVMIDLVIGYTAIQSMGIWSRKNDMILHLHRAGNSTYARQKNHGINFRVICKWMRMAGVDHIHAGTVVGKLEGDPLMVKGFYNVLLNTNTEINLPQGLFFAMDWACLRKTVPVASGGIHCGQMHQLLYYLGDDVVLQFGGGTIGHPDGIQAGATANRVALESMVLARNEGRDYLNEGPQILRDAAKMCGPLKTALDLWKDITFDYTSTDTPDFVETATESK

SEQ ID NO: 14317 - protein, 340 aa, Arabidopsis halleri subsp. halleri
MASCVTGTEVAIRAAACRDGDAASHLKIVAVFAIFLTSVFGVWGPVILAKYFHGKPLYDKAILVIKCFAAGVILSTSLVHVLPEAFESLADCQVSSRHPWKDFPFAGLVTMIGAITALLVDLTASEHMGHGGGGGGGGMEYMPVGKAVGGLEMKEGKFGADLEIQENSEEEIVKMKQRLVSQVLEIGIIFHSMIIGVTLGMSQNKCTIRPLIAALSFHQIFEGLGLGGCIAQAGFKAGTVVYMCLMFAVTTPLGIVLGMVIFAATGYDDQNPNALIMEGLLGSFSSGILIYMALVDLIALDFFHNKMLTTAGESGSRLKKLCFVALVLGSASMSLLALWA

SEQ ID NO: 14318 - protein, 521 aa, Lycopersicon esculentum x Lycopersicon peruvianum
MVLNNINSILEALQANPILIFFFIIPLFFLYLFSTSRRKRYPPGPLGWPLIGNMMIMDQLTHRGLAKLAQKYGGVFHLKMGYVHKIVISGPEEARQVLQVQDNIYSNRPKTVAISYLTYDRADMAFADYGPFWRQMRKLCVMKLFSRKRAESWDSVRDEVDSMVKIVTTNAGTSINLGELVFCLTRNIIYRAAFGTSSDEGQDDFIKILQEFSKLFGAFNMADFIPWLGWIGKQGLNVRLAKARASLDGFIDTIIDDHIERKKAIHVINDDGYRESDMVDELLAFYSEETKVNESEDLQNAIRLTRDNIKAIIMDVMFGGTETVASAIEWAMAELMKSPEDLKKVQQELANVVGLNRKVDESDFENLTYLKCCLKETLRLHPPIPLLLHETAEESTVSGYYIPANSHVIINSFAIGRDKNSWEDPDSFKPSRFLKEGVADFKGGNFEFLPFGSGRRSCPGMQLGLYALEMAVAHLLHCFTWELPDGMKPSELNMDDMFGLTAPLANRLVAVPTPRLLCEIY

SEQ ID NO: 14319 - protein, 214 aa, Lactobacillus gasseri
MQSKRPIIIGIAGGSGSGKTTIAHEIYDQLQQDDHILIMTQDSYYKNNDDLSMSERKKINYDHPDAFDMPLLVEQLRQLMDYKAVEMPVYDFTAHTRSEKTIHTEPADIIILEGILVLGEENLRNLMSIKVFVDTDDDIRFIRRLERDTQERGRSVHSVHSVIDQYLKTVKPMYNQFIEPTKRYADIIVPEGGENDVAIDMLTTKIRSVLSNVK

SEQ ID NO: 14320 - protein, 180 aa, Lycopersicon esculentum
MASSVMSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 14321 - protein, 463 aa, Synechocystis sp. WH 8501
MANLNPTASYSLALTIELPNIAGTLANVTQAIAGAQGSFGQISLIEHNLKITQREITVEASSEEHAEQIVSAVREIPNVKILKVSDRTFELHRKGKITIESRLPLHSQGDLAMAYTPGVGRICKAIATDPSEVYNLTIKNNTVAVVTDGSAVLGLGNLGPEAALPVMEGKAMLFKEFAKVDAFPICLATQDTEEIIETVKRIAPVFGGINLEDIAAPRCFEIEKRLRQELDIPVFHDDQHGTAIVTLAALFNALKLVHKTLEGVRIVINGAGAAGVAIASLLRAAGATTIWLCDSKGLISHNREDLNPQKKAYAVSASGTLADAMQGADVFLGVSAPGVVTPEMVRSMNKDPIVFAMANPIPEIQPELVTNDVAVMATGRSDYPNQINNVLAFPGVFRGALDCRAKNITERMYLEAAKAIASLVHSNQLNAEHIVPSVFDERVSHAVASAVELAARQDGVANQ

SEQ ID NO: 14322 - protein, 101 aa, Triticum aestivum
  unsure (1)..(101): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKXWVPCLEVQQRSGFIFR

SEQ ID NO: 14323 - protein, 413 aa, GIBBERELLA ZEAE PH-1
MAGSPVVTHTVEAAQAQTLGRAISSPLKNVTSQTSSSNGTPMPPVTSAPAPTSIPTTLDLAEQMNDEEKRKYVKGKKLGEGTYAVVFLGHLRSKPTTLVAIKKIKVQKEYDEGMAPDAVRELKHLQELSHPNIISLLSVFSSKDQNLNLVLEYLPLGDLEMLIRDTESVRYGAADIKTWMGMLTRAVWFCHENFVLHRDIKPNNLLIADDGEVKLADFGLARSFADPHQLMSSRVITRWYRPPELLFDAKHYSGAVDVWSVGAVFAELIMRAPYMPGNTDLDQVRLVCELVGTPTDDNWPGVTKLSGYAVPEKHPVRGKDWYEMRFGTVGSDGVDLLMKTLILDPKKRITARGMLEHPWWHSEPKPTRKQDLPRKGGTGADDKMGADLKRRPGVIDDDRGSKVARKLDFGGMN

SEQ ID NO: 14324 - protein, 352 aa, Leptosphaeria maculans
MPPTGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 14325 - protein, 97 aa, Zea mays
  unsure (1)..(97): unsure at all Xaa locations
YTGSFLDPPYAHNDVQPGYVPITRRXKVQPPVATLMDLGSARSARKEISTRSEALQLQEWALEYCPASYRAPEIMGXPSHADIDERTDIWSLGLHSF

SEQ ID NO: 14326 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKLLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVIEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 14327 - protein, 473 aa, Zea mays
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 14328 - protein, 250 aa, Spinacia oleracea
MSRRYDSRTTIFSPEGRLYQVEYAMEAIGNAGSAIGILAKDGVVLIGEKKVTSKLLQTSTSTEKMYKIDDHVACAVAGIMSDANILINTARVQAQRYTFSYQEPMPVEQLVQSLCDTKQGYTQFGGLRPFGVSFLFAGWDKNYGFQLYMSDPSGNYGGWKATAIGANNQAAQSMLKQDYKDDVTREDAVKLALKALSKTMDSTSLTSEKLELAEVYLLPSGKVKYQVHSPESLNRLLTESGLTQPAAETS

SEQ ID NO: 14329 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGAHSAFDAIGGAYAENLPVILISGAPNNNDHAAGHVLHHALGKTDYHYQLEMAKNITAAAEAIYTPEEAPAKIDHVIKTALAKKKPVYLEIACNIASMPCAAPGPASALFNDEASDEASLNAAVDETLKFIANRDKVAVLVGSKLRAAGAEEAAVKFTDALGGAVATMAAAKSFFPEENPHYIGTSWGEVSYPGVEKTMKEADAVIALAPVFNDYSTTGWTDIPDPKKLVLAEPRSVVVRRIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKLL

SEQ ID NO: 14330 - protein, 134 aa, Vibrio diazotrophicus
MRSTGIADTVLVGPEPEFFLFDDVKFSTDMSGSFFKIDDVEAAWNTGSDYEDGNKGHRPGVKGGYFPVAPVDSSQDLRSAMCLIMEEMGLVVEAHHHEVATAGQNEIATRFNTLTAKADEIQIYKYVVHNVAHA

SEQ ID NO: 14331 - protein, 566 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQILEHHHHHH

SEQ ID NO: 14332 - protein, 255 aa, Haemophilus somnus 2336
MARRPLVMGNWKLNGSKAFTKELITGLKDELNAVSGCDVAIAPPVMYLAEAEAALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSINDANAAELFTQPDIDGALVGGASLKASAFAVIVKAAAKAKN

SEQ ID NO: 14333 - protein, 228 aa, Arabidopsis thaliana
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 14334 - protein, 510 aa, Pseudomonas syringae pv. syringae B728a
MPLLNWSRHMVCLTAAGLITVPTVYAADTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGLKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGALNTGHTTSGVNYEPSRLEPRPADDKARYSQLPLSGTTQQAKITREQNFKQAGDLYRSYSAKEKTDLVQSFGESLADTDTESKNIMLSYLYKADPDYGTRVAEVAKGDLSKVKSLAASLKD

SEQ ID NO: 14335 - protein, 531 aa, GIBBERELLA ZEAE PH-1
MGIAGVLKKVVRNDAMKTDPEEIYNWRVFAVVAGSCFGGMLFGWDTGAIGGVLAMKATQERFNYTPEAKVTLDQNIVSTLQAGCFAACFFTSYFTERYGRRWCLIGTGAVTTIGVILQAASTAQGSLPVMYIGRFVAGLGVGAASSLVPLYVSECAPRAIRGGLTSFYQLFIVTGVMLSFWINYGALLHLSAPTVYALPLALQALPAVLLIACMLAAPESPRWCARKDDWERAKSILIGLRQLPETHPYVQTELQEMSAQLEAEKRLTGNASASTLWKELVTIPGNRKRAIISVLLMVCQQMTGVNAVNYYAPQIFQSLGMTGTTVSLFATGVYGIIKVLGCATFLIFFADSLGRRRSLLWTSAAQFLAMYIIGIYGRVEPPVAGAGISAFGYVAIVCIYLWAAFFQFGWGPCCWILVSEIPTARLRALNVAIAAATQWLFNFIVARTVLTMQKTMGPAGYGMFFMFGTFDLLMGIFVWLFVPETKGLSLEQMDELFGVADVQGKLDAEGPEGARTPSIREEVAHIKSNKS

SEQ ID NO: 14336 - protein, 497 aa, Glycine max
MIMMMMMCSMWMWVVLVAIAGALLVLRSILKNVNWWLYESKLGVKQYSLPPGDMGWPFIGNMWSFLSAFKSKDPDSFISSFVSRFGRTGMYKTMMFGNPSIIVTTPEICKRVLTDDDKFTPGWPQSTIELIGKRSFISMSYEEHKRLRRLTSSSINGMEALSLYLTYIEKNVKSSLEKWANMGQIEFLTEIRKLTFKIIMHIFLSSESEHVMEALEREYTALNHGVRAMCINIPGFAYHKAFKARKNLVAIFQSIVDERRNLRKGYLPGKAKDMMDALIDLEDDDGRKLSDEDIIDIMLMYLNAGHESSGHITMWATFFLQKHPEYLQKAKAEQEEIIRRRPSTQKGLTLKEVREMDFLYKVIDETLRVITFSLVVFREAKTDVNINGYTVPKGWKVLVWFRSVHLDPEIFPDPKEFNPNRWNKEHKAGEFLPFGGGSRLCPGNDLAKMEIAVFLHHFLLNYRFEQHNPNCPVRYLPHTRPMDNCLGRVRKCPSTTT

SEQ ID NO: 14337 - protein, 427 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKVDSLFNIESIMCKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 14338 - protein, 338 aa, Glomerella cingulata
MAPIKVGINGFGRIGRIVFRNAIEHPEVEIVAVNDPFIETKYAAYMLKYDSTHGIFNGEIKQEGNDLVINGKTVKFYTERDPAAIPWKETGADYVVESTGVFTTTDKAKAHLQGGAKKVIISAPSADAPMYVMVVNEKSYDGSADVISNASCTTNCLAPLAKVINDKFGIVEGLMTTVHSYTATQKTVHGPSAKDWRGGRTAAQNIIPSSTGAAKAVGKVIPELNGKLTDMSMRVPTTNVSVVDLTARIEKGASYDEIKQAIKEAAEGPLKGVLAYTEDDVVSTDMIGNPNSSIFDAKAGISLNNNFVKLVSWYDNEWGYSRRVLDLLAHVAKVDASK

SEQ ID NO: 14339 - protein, 124 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 14340 - protein, 104 aa, Petunia x hybrida
MAKLASFFLLALIAISIVATTALAADGQYHLDAARYGPGSLKPTQCLPQCIRRCSHTQYHNACMLFCQKCCKKCLCVPPGFYGNKGVCPCYNNWKTKEGGPKCP

SEQ ID NO: 14341 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 14342 - protein, 432 aa, Prochlorococcus marinus subsp. marinus str. CCMP1375
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 14343 - protein, 779 aa, Saccharomyces cerevisiae
MPTTYVPINQPIRDGEDVIDTNRFTNIPETQNFDQFVTIDKIAEENRPLSVDSDREFLNSKYRHYREVIWDRAKTFITLSSTAIVIGCIAGFLQVFTETLVNWKTGHCQRNWLLNKSFCCNGVVNEVTSTSNLLLKRQEFECEAQGLWIAWKGHVSPFIIFMLLSVLFALISTLLVKYVAPMATGSGISEIKVWVSGFEYNKEFLGLLTLVIKSVALPLAISSGLSVGKEGPSVHYATCCGYLLTKWLLRDTLTYSTQYEYLTAASGAGVAVAFGAPIGGVLFGLEEIASANRFNSSTLWKSYYVALVAITTLKYIDPFRNGRVILFNVTYDRDWKVQEIPIFIALGIFGGLYGKYISKWNINFIHFRKMYLSSWPVQEVLFLATLTALISYFNEFLKLDMTESMGILFHECVKNDNTSTFSHRLCQLDENTHAFEFLKIFTSLCFATVIRALLVVVSYGARVPAGIFVPSMAVGATFGRAVSLLVERFISGPSVIIPGAYAFLGAAATLSGITNLTLTVVVIMFELTGAFMYIIPLMIVVAITRIILSTSGISGGIADQMIMVNGFPYLEDEQDEEEEETLEKYTAEQLMSSKLITINETIYLSELESLLYDSASEYSVHGFPITKDEDKFEKEKRCIGYVLKRHLASKIMMQSVNSTKAQTTLVYFNKSNEELGHRENCIGFKDIMNESPISVKKAVPVTLLFRMFKELGCKTIIVEESGILKGLVTAKDILRFKRIKYREVHGAKFTYNEALDRRCWSVIHFIIKRFTTNRNGNVI

SEQ ID NO: 14344 - protein, 425 aa, Bacillus israeli
MIVAEGQKITMTNGTLNVPNDPIIPFIEGDGTGPDIWRAASKVLEAAVEKAYNGEKKIVWKEVLAGEKAFKETGEWLPQETLDVIREYMIAIKGPLTTPVGGGIRSLNVALRQELDLFVCLRPVRYFNGVPSPVKRPQDTDMVIFRENTEDIYAGIEYAKGTEEVKKVIEFLQKELGVNKIRFPETSGIGIKPISEEGTKRLVRAAINYAIEHGRKSVTLVHKGNIMKFTEGAFKNWGYELAEQEFGDKVFTWAEYDRIVEKEGKEAANKAQEEAEKAGKIIIKDAIADIFLQQILTRPREFDVVATMNLNGDYISDALAAQVGGIGIAPGANINYETGHAIFEATHGTAPKYAGLDKVNPSSVILSGVLMLEHLGWKEAADLIIQAMEKTIASKVVTYDFARLMDGATEVKCSEFGNELIKNMG

SEQ ID NO: 14345 - protein, 928 aa, Oryza sativa; identical to SEQ ID NO: 10379

SEQ ID NO: 14346 - protein, 279 aa, Oryza sativa
MWRLKVAEGGGALLRSTNGFLGRAVWELDPDHGTPEDRADVERVRREFTDDRLRRRESADLLMRMQFAKQKKLQRRRDSIPPAVKLGEKEQVTEEIAMASLRRALDEFSSLQADDGHWPGDFSGVMFIMPGLMLGVYEWAGNNPIFPELWLAPQFLPFHPGKFWCLTRMVYLPMAYLYGKKFVGPTTPTILALREEIYPVHYLTIDWAQARSACAKEDLVCPRTRLQNAVWSWLYKWVEPVMSSWAMNKLRGRALDALMEHIHYEDENTQYLCICSVNK

SEQ ID NO: 14347 - protein, 119 aa, Zea mays
KLRKTLEDYPQINYHMINHDGSTDWTNSDPTEPIAVTWGVFPGCEIAQPTVVDPLSFRVWKDEAYDAWLNNWANIYPDGSASRELLHKIHDEYVLVTLVDNDFVKPTVIFELLEKMLNS

SEQ ID NO: 14348 - protein, 168 aa, Glycine max
  unsure (1)..(168): unsure at all Xaa locations
GPPPXIEQIAEANLNIDALCMAFYARSEETRQSHSVHKLALGTLALEHALSSGSPIRSEVELLRKSVEGIDKDSLLELALSSLPEDVLDYGSDTMMGLKQKFNSLKETIRHFSLLPAGGGGILAHTVARVASSIKIKGDNSGDGIESLINKVERLIVDGDLITAXDAL

SEQ ID NO: 14349 - protein, 449 aa, Pseudomonas aeruginosa PAO1
MAIEQFGYRQQLRRSLSLSDLIIYGMIFMIPIAPFGVYGWVHADAHGMVPMAYLVGMLAMLFTALSYGAMAKAFPIAGSVYSYAQRGIHPHVGFIAGWVLLLDYLLIPPLLYVFSALALNHLFPAIPKLAWMLLFLVSATLVNLRGITFAARANLLFLIGELVVLAIFLVVGYQALEGGLGNGRLTLEPLYRPEAFDLGLVMKAASIAVLSFLGFDAISTLAEEVKGDPARQIGRAALIALFIMGGIFIAQTWLATDLAAGMNFKSADTAFYEIAEAAGGQWLSMLTAVATALAWGVTVSITSQAAVSRLLYSMARDGRLPRALARVHPRYQTPHVSLYLVAVLSLGIGWAFLDAPDVLTSLVNFGALTGFCLLHLSVINHYYRRQRSGQWLRHLLFPLVGLAIIAYVLYSMSLDAQLLGLAWIAVGLVYLALLQRGGRQAPTELAKDL

SEQ ID NO: 14350 - protein, 530 aa, Plantago major
MNSEHHNSGGLASFSVDAGKSQKPDAASVLDTLPKKPVTRNKYALAISILASMTSVLLGYDTGVMSGATLYIKDDLKISDVQVELLVGTINIYSLVGSAVAGRTSDWVGRRYTTVFASVVFFVGAILMGIATNYVFLMAGRFVAGIGVGYALMIAPVYAAEVAPASCRGFLTSFPEVFINFGVLLGFVSNYAFAKFPLKLGWRMMLGVGAIPAVFLAIGVIYMPESPRWLVLQGRLGDARRVLDKTSDSLEESKLRLADIKEAAGIPEDCNDDFVQVQKHSQGQGVWRELLLHPTKPVLHILICGVGIHFFQQGIGIDSVVLYSPRIYDRAGITDTSDKLLATIAVGISKTFFILITTFYVDRFGRRFLLLVSCAGVALSMFALGTVLTIIDRNPDAKQTGVLVLVVLLTMVIVGFFSMGLGPIAWVYSSEIFPLKLRAQGCGLGVAMNRFMSGVILMSFISLYKEITIGGSFFLFGGITTLGWIFFFTLFPETRGRTLEEMEGLFGTFFKWRTTMKELDAKKRSGTDGA

SEQ ID NO: 14351 - protein, 154 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLAAKNLYDLPP

SEQ ID NO: 14352 - protein, 335 aa, Zea mays
  unsure (1)..(335): unsure at all Xaa locations
MAPLGDGGAAAAAASNNLVVSFGEMLIDFVPDVAGLSLAESGGFVKAPGGAPANVAYAIAKLGGSSAFVGKFGDDEFGHMLVCVLKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTDATAQDXIAKAN

SEQ ID NO: 14353 - protein, 310 aa, Staphylococcus hyicus
GFGRIGRLAFRRIQDVENIEVVAVNDLTDDDMLAHLLKYDTMQGRFTEEVDVIDGGFRVNGKEVKSFSEPEPSKLPWKDLEVDVVLECTGFFTSKEKAEAHIEAGAKKVLISAPGTGDLKTIVYNVNHEELDGSETVVSGASCTTNSLAPVAKTLHDEFGIVEGLMTTIHAYTGDQNTQDSPHRKGDKRRARAAAENIIPNSTGAAKAIGLVIPEIAGKLDGGAQRVPVATGSLTELTVVLEKEVSVEEVNNAMKNATNESFGYTEDEIVSSDVVGMTFGALFDATQTRVMTVGDRQLVKVAAWYDNEMS

SEQ ID NO: 14354 - protein, 231 aa, Glycine max
  unsure (1)..(231): unsure at all Xaa locations
MARSWLIDIRGFARKVXKNTTLSTDDQMKDCGTYRECPKCHYHIDNSDVSHEWPGFPVGVKFDPSDVELLEHLAAKCCIGDREPHMFIHQFIPTLEGEQGICYTHPQNLPGAKTDGSSVHFFHKTANAYATGRRKRRKIHHQDGLTEEHVRWHKTGRTKAVTEDGVHKGFKKIMVLYIRSKKGSKPYKTNWVMHQYHLGSEVDEKDGEYVVSKIFYQRQKQSEKDEENTVG

SEQ ID NO: 14355 - protein, 497 aa, Pseudomonas putida KT2440
MLSELPILPATRAFLERKLKMRIGADWQDAASGRTLSFRNPATGEVLGEVPAAEAEDVDRAVRAARQAFDDSPWSRMRPRERQNLLWRLADLMERDARQLAELECLNNGKSAAVAQMMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVVTGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANAMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGSAAIEHYTELKSVLIKL

SEQ ID NO: 14356 - protein, 203 aa, Triticum aestivum
  unsure (1)..(203): unsure at all Xaa locations
KKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQXDDWVHYAKMTEEIGEQVQIVGDDLLVTNPTRVAKAIKEKSCNALLLKVNQIGSVTESIEAVKMSKRAGWGVMTSHRSGETEDTFIADLAVGFVHGSD

SEQ ID NO: 14357 - protein, 618 aa, Neurospora crassa
MPIEIDKILAAAPATTRGQATQLSCDPKGERIVYASGKSIFVRTIDEPSKSLQYTGHTTTTTVARFSPSGFWVASGDVSGKVRVWDAVGAENTKGEYSIISGRINDIAWDGDSQRVIAVGDGRERFGHAFTADSGNSVGEVTGHSKVVNAVSIRQQRPLRAATVSDDGSMCFLHGAPFKFADKASEHKGFVTGTAFSPDGATLVTVGADRKIQLYDGKTGAPTKTIGEGVHTGGIYGISWASDSKHFVTSSADQTVRVWDAESGKNTETWRFGPEGSVSIPDQQVGVVWPHGRTDGLIISLNLNGDLSYLVPGNPKPIRVVQGHNKNITALGASPDGQALLTGSFEGRVLSWDLAAGTGTVVDGQSHSNQVTQFALSPSGGTVYSVGWDDTLRSVDVSANTFTGLSTKLSAQPKGIATTSDGKFVVVAAHTGIQVYQGPDFISELPTTFTSTAIAASPTDGSVIAVGGDGNTVRIHSLSSSDGTLSSQPVAVLTNSSAQISTLSFSRDGKFLAAGNSTGKIVVYRTSGSGSWEVETDRWSAHTARVLSIAWNEAGTHAVSGGLDTNVCVWSLAKPGSRTSAPNAHKDGVNGVAWMEEGTVVSTGVDGAVKVWKVSGLP

SEQ ID NO: 14358 - protein, 226 aa, Phytolacca americana
GLVKKAHEISILCDADVALIVFSTKGKLFQYATGSCMEKILERYERYSYAERQLITPDPESHLSWTLEHAKLKARVEILQKNQRNYMGEELDTLSLKELQTLEHQLDSALKQIRSKKNQLMYESISQLQKKDKALQEQNKSLSKEVKEKEKEKEKTMTQQAQWDNQNQDINSSSCLMSDQALPSLNIGMNYQTESGSSSVENEAIQQQNRNNTTIALMPHWMLSHL

SEQ ID NO: 14359 - protein, 284 aa, Bifidobacterium longum NCC2705
MHSPMFTLEVFPPKRNAPVGTIYDTLDGLEGLNPDFISVTYGHGTHSDRTATARIAHTISKEYGIPAVAHLTALYSDKAKIDEALDMFEEAGVSAVLALRGDYIDGEQLVGEFNHASDLVSYIRSVKPDFKVFGACYPEGHYQADSLDQDIENLKIKVDAGVTHLISQLFYDNEDFYRFLDKARAAGITVPIEAGIMPVRGAKSVRRMAERNASRIPDRLNTLLNKWGDDIQSLRAAGILYASEQIADLVAHDVDGVHLYSMNHPATTRRIWRNAEPLFRGTQG

SEQ ID NO: 14360 - protein, 110 aa, Oryza sativa; identical to SEQ ID NO: 6810

SEQ ID NO: 14361 - protein, 474 aa, Oryza sativa
MNLAGFLATPATATATRHEMPLNPSSSASFLLSSVRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 14362 - protein, 899 aa, Oryza sativa
  unsure (1)..(899): unsure at all Xaa locations
MRRHPLLPLLAAVLVGAAVRAGKIATEVVVPDFVASYLLFIDTYGVFLQSGGGGAFQAVVYNPAGQQDRYYLAVVHAPSKTCVWVANRDAPITDRAAPLRLTARGISAEDPNGTVVWSTPAFASPVAALRLDESGNLALLDGRNRTLWQSFDRPTDVLVSPQRLPVGGFLASAVSDSDYTVGGYRLDVTAADAALTWNGSLYWLLSIDVKSTRDRDGAVASMAVNGTGLYLLAADDTVLIQLPLPDAKLRIVKLGVEGKLVITSYASANATSPSPTDAGFVAPNSGCDLPLSCGALGFCAPNGNASSCTCPPLFASSHDGGCTPADGSKAMTVASCGGAGGDAAPTSYISLGNGVAYYANRFSRPDMVGSNGSSCQALCSGNCSCLGYFYDESSLSCFLVQHQIGSLVNANSRRGDMVGFIKVQSSQSPGSPSGSSSNNSTLIAILLPTIVAFVLVVVVGAVIVVSWRKQERRAGRRASRSRDVQLRRHRSPASDSAHLVYGNDDDGNDIVIPGLPTRFTHEEIEDMTNSFRIKIGAGGFGAVYKGELPDSSAVAVKKIEGVGMQGKREFCTEIAVIGNIRHVNLVRLRGFCVEGQRRLLVYEYMNRGSLDRTLFRPAAGQPLEWKERMEVAIGAARGLAYLHFGCDQRIIHCDVKPENILLADGGQVKIADFGLAKLLTPEQSGLFTTMRGTRGYLAPEWLTNTAITDRTDVYSFGMVLLELVRGRKNRIEHVSDGAGAATGDDSNSSNGTTGSSSRGARSDYFPLMALEGHXAGQYAALADPRLEGEGVAGEVERVVKVGLCCLHEDPQLRPSMAMVAGMLEGTMELWEPRVQSLGFLRLYGRGFAGPADGSGGSGGGIKQAMAGSNGDHTRSGTTTVTTMSGWPSYMSSSQLSGPR

SEQ ID NO: 14363 - protein, 502 aa, Oryza sativa (japonica cultivar-group)
MRKAAALASAAMAAAAVAVVSTVLHQRQRRAAKRSERAEAVLLRDLQERCAAPVELLRQVADAMAAEMRAGLAAEGGSDLQMLVTYVDSLPSGGEKGMFYALDLGGTNFRVLRVQLGGKERRIIKQDSEGISIPQHLMSSSSHELFDFVAVALAKFVASEGEDCHLPEGTQRELGFTFSFPVKQKSLASGTLIKWTKSFAIDEMVGKDVVAELNMAIRSQGLDMKVTALVNDTVGTLAAGRYVNHDTIAAVILGTGSNAAYIDHADAIPKWHGSLPKSGNMVINMEWGNFKSSHLPLTEFDQELDAESLNPGKQVYEKSISGMYMGELVRRILLKMAQETRIFGDNIPPKLERPYILRTLDMLIMHHDTSSDLRTVANKLKEVLGIEYTSFTTRKLVLDVCEAIATRGARLAAAGIYGIIQKLGQHSDSPSTRRSVIAVDGGVYKYYTFFSQCMESTLSDMLGQELAPSVMIKHVNDGSGVGAALLAASYSQYHQAESADSS

SEQ ID NO: 14364 - protein, 466 aa, Acanthopeltis japonica
YAKMGYWDPDYVVKETDVLALFRVTPQPGVDPVEASAAVAGESSTATWTVVWTDLLTACDLYRAKAYKVDLVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERYLYSMEGVNRSIAASGEIKGHYMNVTAATMEDMYERAEFAKQLGTIIIMIDLVIGYTAIQTMAIWARKNDMILHLHRAGNSTYSRQKNHGMNFRVICKWMRMAGVDHIHAGTVVGKLEGDPEMIRGFYNTLLFTHLDMNLIQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 14365 - protein, 85 aa, Triticum aestivum
VTEAIQACKLAQERGWGVMVSHRSGETEDTFIADLVVGLCTGQIKTGAPCRSERLAKYNQLMRIEEELGDEARFAGHNWRNPSVL

SEQ ID NO: 14366 - protein, 301 aa, Zea mays
MAGLSLEHPWAFAFGLLGNVISFMTFLAPIPTFYRIYKSKSTEGFQSVPYVVALFSAMLWIFYALIKSNETFLITINAAGCVIETIYIVMYFVYAPKKAKLFTAKIMALLNGGVFGVILLLTLLLFKGSKRVVLLGWICVGFSVSVFVAPLSIMRRVIQTKSVEYMPFSLSLSLTLSAVVWFLYGLLIKDKYVALPNVLGFIFGVVQMVLYVFYMNKTPVAAAVGKDAGKLPSAADEHVLVNIAKLNPALPERTSGMHPVTQMAAVPARSCAAEATAPAMLPNRDVVDVFVSRHSPAVHVV

SEQ ID NO: 14367 - protein, 347 aa, Catharanthus roseus
MDLETAEIRKAQAQYSRHVFSFVSTSCLKCAIQLEIPEAIHNHGKPMTLSDLTNSLPINPSKAPYIHRLMRILVAAGYFSEEPKNVYSLTSLSRILVKNQPLNLREFVLSANEIAEVEGWNALSEWFQNDVATAFQTAHGKTYWEYLSQDKYGKNFDQLMATDSLLISKLLIPDYNYLFEGLISLVDVGGGTGTLAGAVAKAFPNLKCTVFEQPHVIADLEAKGNLEFVGGDMFEKIPSANAILLKSVLHDWKDEDSVKILKNCKKAIPEKEKGGKVIVIDIVLMDSKKHDNPLVKSQISGDMDMMVSMGAKERTEEEWAALFKEAGFSGYKIFPMLDFRSPIEVYP

SEQ ID NO: 14368 - protein, 506 aa, Pyrococcus furiosus DSM 3638
MSKFIHHKIFDEIYEIGEDGVPEFKTYIAGKWIYGEKFKDIKSPINGEVIARVSILSREQIEEAISTTYEIGREKIRDYPGEKRISSFLKAAEMMKEAFDDFVRILILDAGKPKSNAMGEVKATIERLEKTTFEFGRLIGDYIPGDWSEETLESEAIVKREPYGLILAISPFNYPLFISATKVIPALLSGNAVLLKPASADPLAPILFTRVLELSGLPKESFSLLTVPGGFMDDIVRDKRIRAITFTGSTEVGEHIIRTGGIKAYHLELGGKDPAIVLNDANIEESVEKIVKGIVTYSGQRCDAIRLILVEEDIYEQFRESLVAQLSKIEPKNPLEDENAIMGPLIDEDSANYIEEIYKDAIEKGARPLLEFRRRGNYVWPIVLEVNNEILPTLRAFNEDVFGPLALLIKVKDEDEAIEIANSSRFGLDAAVFTTCEKRARKVARKLEVGSVFINEYPRHGIGYYPFGGMKDSGIGREGIGYSLEMLTTTKTIVHNFRGQGVWEYI

SEQ ID NO: 14369 - protein, 545 aa, Oryza sativa (japonica cultivar-group)
  unsure (1)..(545): unsure at all Xaa locations
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGXXADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 14370 - protein, 238 aa, Petunia x hybrida
MGRGKIVIQRIDNTTSRQVTFSKRRSGLLKKAKELSILCDAQVGLIIFSSTGKLYEFASNSMRSVIERYYKMKEEHHLMSPMSEVKYWQREVASLRQQLHYLQENHRQLLGEKLSGLGIKDLTHLENKLEMSLKGVRKQKEQILTDEIKEITRKGNLIHQENIELYKKVNLIRQENTDLQKKVYEKGCGSEPNEGVQATFAISNGYDLHAPIYLQLRPPQTQKNQTSTSVMQFGLQLH

SEQ ID NO: 14371 - protein, 190 aa, Hevea brasiliensis
SEVLTPADEENHINKHNFRIPFVCGCRNLGEALRRIREGAAMIRTKGEAGTGNVIEAVRHVRSVMGDVRVLRNMDDDEVFSFAKKIAAPYDLVMQTKQLGRLPVVQFAAGGVATPADAALMMQLGCDGVFVGSGVFKSGDPARRARAIVQAVTHYSDPNMLAEVSCGLGEAMVGINLNDKKVERFANRSE

SEQ ID NO: 14372 - protein, 245 aa, Zea mays; identical to SEQ ID NO: 12879

SEQ ID NO: 14373 - protein, 510 aa, Nicotiana tabacum
MALLDLQPSTSLLFCLVPLLFLFFIKFNKTITNTLLSSNSSKIPRSYPLIGSYFSILANHDQRIKWISDIILSTPNLTFTLIRPLNFHTIFTANPSNVQHMLKTNFQVYQKGHNSNTTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFILPFPLIWKMKRALNIGSEKKLRFAVEQVREFAKEIVREKQRELKDKSSLDSADLLSRFLSTGHSDENFVTDIVISFILAGRDTTSAALTWFFWLISKHPEVESQILKEIGEKSESLLLYDEVKNMIYTHASLCESMRFYPPVPMDTKEATKDDILPDGTFVKKGNRVTYHPYAMGRVEKVWGKDWAEFRPERWLDKDEVTGNWTFVSKDAYTYPVFQAGPRVCLGKEMAFLQMKRVVAGVLRRFKVVPVVEQGAEPVFISYLTAKMKEVFPVTIEERI

SEQ ID NO: 14374 - protein, 247 aa, Glycine max
MSTAVARPFGGFPGSGRTKGDELLGKKMSDGFFIEEEEEEEAEEVLTESSSIGAPSPSSSSIGEDSSSEVGGEGEDEEVESKLKEEPGLGCLDALEDSLPIKNGLSSFYAGKSKSFTSLAEAAARDAVKELAKPENPFNKRRRILATWSRRASCSSLATATYLPPLLAPDHALPEGDEGEEDDDSDSGSDEQHRGKNGWEAPALPPPRLSVNTQMGASAARRGGSFRSPRSYSLSDLRNGGDASYNQ

SEQ ID NO: 14375 - protein, 460 aa, Absidia zychae
MFGKRALTSLLVTLGVALVCAPVTVQAHPMSHVLRRQDGNDTSSGNTTQLKYTSPKLCDPDVKQYSGYLDAANDEHYFFWFFESKNDPKNDPLTIWLNGGPGCSSLIGLWEELGPCQQNGSANPHSWHHSSNMLFFDQPDGVGFSYGKQTVSTTEDAAERAWTFLQAFYETFPQYSKLDVHYFGESYGGHYIPGFASHVVDMNKKVQSGEEKGVVVPLKSIGVGNGFIDAVIQYKSYPKMTCHSTYPAVLSEEECDKMQQIYENDCKPAAEQCAESDEDSDCVNANQQCGQIEGIYAQSGYSFYDIRQQGDDTPHPFVDELNKASVIKEVGARGHFSMCSDSVGTAFAQTGDGARSYIPAVEKLLKEGIPVLIYVGDADVICNWYGNLDVADSLKWDGSDAFSKTKLEAWKADGKEVGQFRSADKLTFVRVYEAGHEVPMYQPEAALSMFQTWISGKSFG

SEQ ID NO: 14376 - protein, 389 aa, Oryza sativa (japonica cultivar-group); identical to SEQ ID NO: 8272

SEQ ID NO: 14377 - protein, 376 aa, Bacillus cereus ATCC 14579
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKESDVSISVIEVPWDEASRFGIMNTNEEMEIVEFEEKPQFPRSNLASMGIYIFNWSILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 14378 - protein, 417 aa, Chloroflexus aurantiacus
MRIVAMIMAGGEGTRLSVLSEKRAKPSVPFAGKFRIIDFTLSNCVNSGIFDVAVLTQYRPHSLNEHIGIGKPWDLDRARGGVRLLQPYQGRRDESWYRGTADAIYQNLNYIQERRADLVLILSGDHIYKMNYNDIIKTHLQKRADLTVAVMEVPIEETDRFGIMTTDEHDRIIEFTEKPKARDKGNLASMGIYVFNADILIRRLSEGGPEKPRIDFGKDVIPAMVAEDRVFAHRFKGYWVDVGTIQSYWETSMQLLDPSLDFDLFDPNWLIRTRSEERPPAKIGPQAKVTQSIICNGCTIRGTVIHSVLSPGVYVSPGAIVRDSVVMNDTWIGPGAVLDRVIVDKKVVVGAGARLGFGDDLTVPNRKQPDKLNSGVTVVGKSAHIPAGITIGRNVVINADRDAEDFPAGDVPSGETI

SEQ ID NO: 14379 - protein, 423 aa, Lycopersicon esculentum
MATPMAEDSNFEDDQLHAMSTEDIIRASRLLDNEIRIIKEELQRTNLELDSFKEKIKENQEKIKLNKQLPYLVGNIVEILEMNPEEEAEEDGANIDLDSQRKGKCVVLKTSTRQTIFLPVVGLVDPDNLKPGDLVGVNKDSYLILDTLPSEYDSRVKAMEVDEKPTEDYHDIGGLEKQIQELVEAIVLPMTHQERFQKLGVRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPTEEARARILQIHSRKMNVNPDVNFEELARSTDDFNGAQLKAVCVEAGMLALRRDATEVTHEDFNEGIIQVQAKKKASLNYYA

SEQ ID NO: 14380 - protein, 468 aa, Chorda filum
IPYAKMGYWDADYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPYAYLKTFQGPATGIIVERERLDKFGRPFLGATVKPKLGLSGKNYGRGVYEGLCGGLDFLKDDQNINSQPFIGWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLGGDPLMGRGFYNTLLLTQLKINLAEGLFFDMDWASLRKCVPVASGGIHCGQMHQPLYYLGDDVVLQFGGGTIGHPDGIQSGGTANRVALEGMVLARNEGRDYFGEGPKILRNAASTCGPLKAALDLWKDITFDYTSTDTPDFVEQTTETN

SEQ ID NO: 14381 - protein, 302 aa, Neurospora crassa
MSVLITGPSEGGLGAETAISLAHANPALLILVGRSLNKIQPTIDAIHAVNPSIAVKFIAADLTSLNSVREAARSILDDASIAHIDVLINNAAVMACPYELTVDGFEMQFATAHLGHFVLTKHILPKLRASAGAGKPQTRIINVSSLGNTLGGIRWDDPSYTKRPEEYKPWDAYGQAKTANVLFTVALNKRLLAKTGIRSYALHPGGIYTPLLRHMNDELMEEITQRVTKGEMQLKTVQQGCATTLRAALDPELEKAGEDGVFLSDCQFTKDPELVAPRALDEEDAERLWGLSEELVGEKFEL

SEQ ID NO: 14382 - protein, 540 aa, Agrobacterium tumefaciens str. C58
MRCGTAPPLYRTAPSRPTFLPCGPLRIVFIREDEIMNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 14383 - protein, 175 aa, Hordeum vulgare
HAKLSLLPNQQAADEELSTYYRDGFAAQHGSSPWLRRFLEKHKTVKTGLLVVVLCAASMVIGDGVLTPAISVLSSMSGLQVRATGLQERSVVLLSCIVLVGLFSLQHRGTHKVAFMFAPIVIIWLLCIGGIGLYNIVHWNPKIYQAISPYYIVKFFRTTGTDGWIALGGILLSMT

SEQ ID NO: 14384 - protein, 294 aa, Vigna radiata
EHPQFTKNDFYITGESYAGHYIPALASRVHQGNKAKEGIHINLKGFAIGNGLTNPEIQYQAYTDYALDRGLIQKADYNSINKLLPSCKQAIEDCGTEGGETCVTSLYVCNKIFNRIMNIAGDVNYYDIRKKCVGDLCYDFSEMEEFLNKKTVRDALGVGDLDFVSCSSTVYSAMMEDWMRNLEAGIPALLEDGIKVLVYAGEEDLICNWLGNSRWVQAMEWSGQKEFGASGAVPFLVDGAEAGTLKSHGPLAFLKVYEAGHMVPMDQPKAALTTLRSWMQGKLTMTKNGDKRLS

SEQ ID NO: 14385 - protein, 451 aa, Streptomyces avermitilis MA-4680
MSDLPRKAVTRTAKLAALPLGFAGRATWGLGKRIGGKSAEIVGRELQQRTAEQLFKVLGELKGGAMKFGQALSVFESALPEEVAGPYRAALTKLQEAAPPMPTRTVHAVLQERLGEDWQELFLEFEDKPSAAASIGQVHRGVWHDGREVAVKVQYPGAGEALLSDLNQLSRFARLLGPLIPGMDIKPLITELRDRVSEELDYALEAQAQLAHAEEFADDPDVVVPAVVHQSEQILVTEWIDGIPLSEVIADGTQEQRDRAGQLLARFLFSGPARTGLLHADPHPGNFRLLPDGFDEKAGWRLGVLDFGTVDRLPGGLPTPIGDSLRMTLDGDAESVYELLREEGFVKESIELDPDAVLDYLLPIIEPAQADEFTFTRGWMRSQAARIADPRSPAHQLGKQLNLPPAYLLIHRVTLSTIGVLCQLGATVRLRDELEEWLPGFLLEEESAAEA

SEQ ID NO: 14386 - protein, 409 aa, Coxiella burnetii RSA 493
MNGFVVSAVLIGAFLGALFSGHLADYIGRKRLLIIDALIFIVGTAISSMTVSISWLVIGRIIVGIAIGIASYSAPLYISEISPPHRRGALVSLNQLAVTIGIFLSYVVDYYFARHDAWRSMFAAGVIPAALLLLGMIVLPYSPRWIFSRGHEEKALWILRKLRGHGPHAEQELEHIRASLQQQKGDWRTLFSKIIRPTLFIAIGLAVFQQVTGINTVLYYAPTILKMTGFQASQTAILATMGIGAVLVIITIISLPLIDSLGRRPLLFIGVGAMTVSLLVLSWSFKVHGHMDYMRWIAFGSLLVFISGFSISLGPIMWLMFSEIFPLRVRGLGASIGACTNWASNWLVTITFLTLIEYLGPSGTFFIYFIISVITLIFIYTSVPETKGVTLEQIEENLYAGKDMRYLGK

SEQ ID NO: 14387 - protein, 606 aa, Zea mays; identical to SEQ ID NO: 5450

SEQ ID NO: 14388 - protein, 496 aa, Burkholderia fungorum
MESLMSTNLEQLARALIRTDNFINGQWIAAASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGLQ

SEQ ID NO: 14389 - protein, 331 aa, Triticum aestivum
MTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYGRTRLANDAKASKGGGDRQFNGLVDVYRKTLKSDGIAGLYRGFNISCVGIIVYRGLYFGLYDSLKPVLLTGTLQVCSFASFALGWLITNGAGLASYPIDTVRRRMMMTSGEAVKYKSSLDAFQQIPAKEGAKSLFKGAGANILRAIAGAGVLSGYDQLQILFFGKKYGSGGA

SEQ ID NO: 14390 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 14391 - protein, 290 aa, Helicobacter pylori 26695
MDYKCFKGKHANIVIEIISLLEKGVKKAQEILEKPDAGSYTKLENSSGDTPIKADLALDKFLEENFLSLENIKSVFSEEKETPVTKENGSYLIAYDPLDGSSVMEANFLVGTIIGIYEKDYKAQNLAASLYVVFGHKIELVVALEEVYRYSFYQNKFHFIETIVLENKGKIVASGGNQKDFSLGLKKALEGFFAENYRLRYSGSMVADVHHVLVKKGGMFSYPQKKLRKLFEVFPLALMVEKAKGEAFYFDKGVKKRLLEQSVENYHEKSECYLASQHEAHILEKYLKGE

SEQ ID NO: 14392 - protein, 317 aa, Gardnerella vaginalis
MDYKHRSILDSLPNYKQGKPAPALDGIRAYKISSNENPFEPLESVKDAISNRALGVINRYPNMRGTEVVEELAKKFSVTPNEVVLGCGSTEVITQLVDLVAGPGDEVIYPWRSFEAYPIIVTGAGATSVKIPNRADGSHDVDAMIDAINERTRLVILNNPNNPTSAQLSDEDARKVLDAVPSDVLVLIDEAYVQFNNAKGTADGMQLYREYPNVVVAQTFSKAYGLAGLRIGYAIGAADVVDGMRKVAVPFGVSQIAQVAAIASLEPQALVEMRNRVDALVKERNRVVSGLREQGWNIAEPYANFFWMPFGESPGAY

SEQ ID NO: 14393 - protein, 335 aa, Thermotoga sp. RQ7
STFVAGLEKLKKGEIEPYGVPLAGELPIDFKDIRIVGSYDVDRAKIGKKLSEVVSQYWCDVNSLSDDPAVSTGVHLGSVKNLPIEAEGLEDSMTLKEAIERLVDEWSKLDPDVIVNTCTTEAFRPFGNKEELLKAIEDNDKERLTATQVYAYAAALYAKKRGGAAFVNVIPTYIANDPAFVELAKENNLVVFGDDGASGATPFTADVLSHLAQRNRYVKDVAQFNIGGNMDFLALTDEGKNKSKEFTKSSIVKDILGYDAPHYIKPTGYLEPLGDKKFIAIHIEYTSFNGATNELMISGRINDSPALGGLLVDLVRLGKIALNRKEYGTVYPVNA

SEQ ID NO: 14394 - protein, 493 aa, Pseudomonas syringae pv. tomato str. DC3000
MSLTRFQMCIDGQWVDALSGKTFDSLNPALAEPWAQLPDAGEADVERAVQAAQKAFESQEWRGLTATARGKLLRRLGDLIAENKEHLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIAPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPLDESTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 14395 - protein, 843 aa, Trichodesmium erythraeum IMS101
MRGVLMAGGSGTRLRPLTCDLPKPMVPILNRPIAEHIINLLKKHQIREIIATLHYLPDVMREYFQDGSKFGVQMTYSVEEEQPLGTAGCVKNIAELLDGTFLVISGDTITDFDLSAAIEFHQKHKSKATLVLTRVNNPIEFGVVITDEEQRIKRFLEKPSTSEVFSDTVNTGTYILEPEILDYLPSNQECDFSKELFPLLLDKNEPIYGYIAEGYWCDVGHLDSYRKAQYDALQHTVKLELPYKERSPNLWIGENTYIDPTAKIETPTLIGDNCRIGPRVHIELGSVIGDNVTIGADANVKRPIVWNGTLVGEDTNLRGCVICRGSRIHRRAQILEGAVVGSLSTVGEEAQISPHVRVWPSKTVESGAILNINLIWGTTAQRNLFGQRGVQGLANIDITPDFAVKLGAAYGSTLKNGSTVSVSRDQRNISRMVSRSLIAGLMSVGINVINLQSTAIPIARTILPTMNLVGGLHVRLSPDRSDQILIEIFDYQGINISKVKEKNIEGAYFKEDFRRVQISEIGNMIDRHEVLNAYSKGFENLLNSEAIRYSKSKVVIDYCYGVSGAVLPQLLTKFGCDAVVLNASLKETSLGIEERENLLDQLGRVVEALQANVGVQVTANGEQLILVDEVGSAIRGETLTALMVNLMLTAHPRGTVVVPINASAAVEQIAHRHDSHVIRTKANPTALMKACQINHNVVLGGSGDMGFIFPKLHPGFDAMFCIAKVIEMLTIQERSLGQITADIPPITHRCYTIRCPWKVKGALMRYLVETNPPEKLELTDGVKIINHQDNYWVLVLPDAGKPLVHIYADSNDRDWVDKTLRDYRNMIHDFVNLFMTRNQLDNL

SEQ ID NO: 14396 - protein, 342 aa, Glycine max; identical to SEQ ID NO: 9252

SEQ ID NO: 14397 - protein, 162 aa, Eubacterium acidaminophilum
MNVGIITVSDKGYAGERLDESGPEIKRILSENGHSYSEYVIVPDEEGMIYNEIVRMCDELRLDLVLTTGGTGFSKRDVTPEATLKAITRNAPGICEAIRQNSLAITRRAMLSRAVSGIRGETIIVNLPGSPKAVSESLEFAIDSIEHGVQILKGVAIECARK

SEQ ID NO: 14398 - protein, 174 aa, Triticum aestivum
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 14399 - protein, 309 aa, Hevea brasiliensis
MAGTGVVAVYGNGAITETKKSPFSVKVGLAQMLRGGVIMDVVNPEQARIAEEAGACAVMALERVPADIRAQGGVARMSDPQLIKEIKQSVTIPVMAKARIGHFVEAQILEAIGIDYVDESEVLTPADEENHINKHNFRIPFVCGCRNLGEALRRIREGAAMIRTKGEAGTGNVIEAVRHVRSVMGDIRLLRNMDDDEVFTFAKKIAAPYDLVMQTKQLGRLPVVQFAAGGVATPADAALMMQLGCDGVFVGSGVFKSGDPARRARAIVQAVTHYSDPDMLAEVSCGLGEAMVGINLNDKKVERFANRSE

SEQ ID NO: 14400 - protein, 230 aa, Prochlorococcus marinus subsp. pastoris str. CCMP1378
MHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 14401 - protein, 436 aa, Arabidopsis thaliana
MGFQNEASSSSYTLKIPPPAREDTPLLGKGPPLSSQFKTFANVFIAVVGAGVLGLPYAFKRTGWLMGVLLLVSVSVLTHHCMMLLVYTRRKLDSFNAGISKIGSFGDLGFAVCGSLGRIVVDLFIILSQAGFCVGYLIFIGTTLANLSDPESPTSLRHQFTRLGSEFLGVSSKSLYIWGCFPFQLGLNSIKTLTHLAPLSIFADIVDLGAMAVVIVEDSMIILKQRPDVVAFGGMSLFLYGMGVAVYSFEGVGMVLPLESEMKDKDKFGKVLALGMGFISLIYIAFGILGYLAFGEDTMDIITANLGAGLVSTVVQLGLCINLFFTFPLMMNPVFEIVERRFSRGMYSAWLRWVLVLAVTLVALFVPNFADFLSLVGSSTCCVLGFVLPALFHLLVFKEEMGWLQWSSDTAIVVLGVVLAVSGTWSSLSEIFSVKV

SEQ ID NO: 14402 - protein, 87 aa, Zea mays
  unsure (1)..(87): unsure at all Xaa locations
LTAPIILDLVLLAELSTRIQLKPEGTDKFHSFHPVATILSYLTKAPLVPLDTPVVNALANQRAMLENIMRXACVGLAPENDMILEYK

SEQ ID NO: 14403 - protein, 370 aa, Triticum aestivum
MSGGVDPETPPSSGGSATGSPMARKPPRHQLTAIRHCASSARIAAASTDLGLDSGTLSLISPADIRPSFLPVFRSGSCANIGPKSYMEDEHVCIDSLIEHLGMRTPAIPAPGAFYGVFDGHGGTDAVCFVRKNLLKFIIEDGHFPNSMEKAIRSAFVKADHAIADSHSLDRNSGTTALTALIFGRTLLVANAGDCRAVLGKRGRAVELSKDHKPSCKSEKLRIENLGGIVFDGYLNGQLSVARAIGDWHVKGSKGSISPLTPEPEFQEVRLTEEDEFLIIGCDGLWDVMTSQCAVSMVRKELMAHNDPERCSRELVQEALRRDTCDNLTAVVVCFSADPPPQIEIPRFRVRRSISMEGLHMLKGALDSNA

SEQ ID NO: 14404 - protein, 190 aa, Triticum aestivum
RGNPTVEVEIITAKGAFRADVPSGASTGIHEALELRDKIKADYCGKGVLQAIENVNQTIGPALVDSGLVVTDQKAIDTFLIDLDGTTNKSKLGANAILGVSLAVAKAGAAEKEVPLYVHFADLASSKKPFVLPVPSFNVINGGSHAGNKLAMQEFMIMPTGAASFSEAMKIGTEVYHTLKGVIKDKYGQD

SEQ ID NO: 14405 - protein, 499 aa, Aspergillus shirousami
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 14406 - protein, 137 aa, Enterococcus faecium
MANVPSIRDMFPDFNDVFSPAFNDFLGVSSYPKVDLVENEKEYKLTADMPGCDKEDTTVEYSDNTLTISANHESHTEDKEDGNYVRKERHSVSYKRSFYLPNVDEEKITGTFKNGVLKLVLPKTAYQPKETKKIELN

SEQ ID NO: 14407 - protein, 182 aa, Burkholderia pseudomallei
MQYQHIKVPEGGDKITVNKDFSLYVSDQPIIPYIEGDGTGFDITPVMIKVVDAAVEKAYGGKKKIHWMEIYAGEKATKVYGPDVWGPEETLQVLKEYVVSIKGPLTTPVGGGIRSLNVALRQELDLYVCLRPIQYFKGVPSPVREPEKTNMVIFRENSEDIYAGIEWAAESEQAKKVIKFLQ

SEQ ID NO: 14408 - protein, 392 aa, Zea mays
MKRYTYDPSVSHVQELFEAAKAANDLNAIAAILGKYPYHPESLLTFAELFKYSGEHQSSADAVEKCLFALECAWHPLFSPLQGNYQLKFNHDTNKPLFTALFSHMKNLDRRGCHRSALEVCKFLLSLDFDDPKGSLFCIDYFALRSQQYKWLEQFAEEYQCDNSLWLFPNFSFSLATARFYLECDAASEGSDDADKSTSLDLMKQALMLHPMVLRKIVDKAPLKDSSWTQILRNVFFGSAKPGSPSLEHMINIYVERHYIMWRFPELQNLLKEAALLVIESLKQDNREALDWACVRKEAFSSDKNEYSHLLVSDFTDTTPSLPPEELRPFMVGPGMLHEMPPVEQEAGPERLRAPREVAGRNPAVVFLESLLPWVDYGDNHQGANDDDNDDD

SEQ ID NO: 14409 - protein, 513 aa, Vibrio parahaemolyticus RIMD 2210633
MVSTHWRATMQMSKSFLLITVGLASTSLQAQTLTRDNGAPVGDNQNSITAGENGSVLLQDVHLIQKLQRFARERIPERVVHARGTGAHGEFVASGDFSDLTVSAPFTEKGKVTPVFVRFSTVIHSKGSPETLRDPRGFATKFYTEQGNWDLVGNNLPVFFIRDSIKFPDMVHSLKPSPVTNVQDPNRFFDFFSHEPSATHMLTWVYSNLGTPASYRTMDGFGVHAYKWINQQGDVNYVKFQWKSQQGIKSLRPNKVTEMQGKDFNHLTNDLYAAIGRGNYPKWDLYVKVLSPEALSKLDYNGLDATKVWLNVPDRKVGTMTLNRLPENFFLETEQSAFAPSNLIPGIEPSEDRLLQGRLFAYADTQLYRLGANLFQLPVNRPLTSVNNHNQNGLSNNAQLSNGDVNYEPSRKLNLAEDNQFKAVETKLVGTVQQKAISKPRDFYQAGVLYRSMNEQDRSDLIANLAGDLNKVIDKDIKATMVSYFYRADKEYGSRLAEATDTNLSQVKNKAMM

SEQ ID NO: 14410 - protein, 492 aa, Cucurbita pepo
MDPYKYRPSSAYNTPFCTTNSGAPIWNNTAVMSVGERGPILLEDYQLIEKIATFTRERIPERVVHARGASAKGFFEVTHDVSDLSCADFLRAPGVQTPVIVRFSTVIHERVSPETVRDPRGFAVKFYTREGNFDLVGNNFPVFFVRDAMQFPDVIRAFKPNPKSHLQESWRFLDFCSYHPESLLSFAWFYDDVGIPINYRHMEGFGVQAYSLINKAGKARLVKFHWKPTCGVKSMLEEEAIRVGGSNHSHATQDLYESIAAGNFPEWRLYIQTIDYEDQNNYDFEPLDTTIAWPEDVVPLRPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDACRHAEKYPMPPNVLSGKRERCVIPKENHNFKQAGDRYRSWAPDRQERFVNRFVEALSDSKVTHEVRNIWISYWTQADRSLGQKIASRMNARPNM

SEQ ID NO: 14411 - protein, 262 aa, Nicotiana tabacum
  unsure (1)..(262): unsure at all Xaa locations
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 14412 - protein, 145 aa, Triticum aestivum
QLAFCPAITVPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 14413 - protein, 318 aa, Zea mays
MQYQPIQNYCRCFLTVKKKKKKKKKKKKKKKKKAAKSNLEAPLSLSLSLFAVRSSAPQSNRHLAEMGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 14414 - protein, 73 aa, Glycine max
  unsure (1)..(73): unsure at all Xaa locations
LKRASINSTYIISYKPYRNNDGINLSHPQTLRXKEIFNSNVFNYMFNTNSILYKPGEHPNHEVHINFAPYSFY

SEQ ID NO: 14415 - protein, 536 aa, Oryza sativa; identical to SEQ ID NO: 12898

SEQ ID NO: 14416 - protein, 181 aa, Glycine max
QPTSIVSYNHLGNNDGMNLSAPQTFRSKEISKSNVVDDMVNSNAILYEPGEHPDHVVVIKYVPYVGDSKRAMDEYSSEIFMGGKNTIVLHNTCEDSLLAAPIILDLVLLAELSTQIEFNSENEGKFHSFHPVATMLIYLTKAHLVPPTSPGVNALSKLRAMLENILRACVGLATDNNIILD

SEQ ID NO: 14417 - protein, 355 aa, Oryza sativa
LQGGVFLQLYASGFNFLDFHYYEVFATVGGNRVTTYSSLKDGNFAILQAYIDEDKDESFYTLSWACDLDGTPLLVAAGSNGIIRVINCATEKLLKTFVGHGDSINEIRTQALKPSLIISASKDESVRLWNVHTGICILIFAGAGGHRNEVLSVDFHPSDIYRIASCGMDNTVKIWSMKEFWPYVEQSFTWTDLPSKFPTKYGQFPVLVAVVHSNYVDCTRWLGDFILSKSVDNEIVLWEPKTKEQSPGEGSIDILQKYPVPECDIWFIKFSCDFHFNQLAIGNREGKVFVWEVQSSPPVLTARLTNPQCKSAIRQTAVSFDGSTILACSEDGSIWRWDEVLRRSDAGGNFGTRKK

SEQ ID NO: 14418 - protein, 161 aa, Elaeis guineensis
AEENRHGDLLNKYLYLSGRVDMRQIEKTIQYLIGSGMDPRTENSPYLGFIYTSFQERATFISHGNTARHAKEHGDLKLAQICGIIASDEKRHETAYTKIVEKLFEIDPDGTVLAFADMMKKKISMPAHLMYDGQDDNLFEHFSAVAQAFGCVHGQGLCRHT

SEQ ID NO: 14419 - protein, 774 aa, Brucella melitensis 16M
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDGRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAEKMRQAAAILAEKAPDLESDGEMHGDAALSQTLRDRVFPNSRLKGEANLLVFPNLDAANITLNVVKAVTDALHVGPILLGATRPAHILTPSVTSRGVVNMTALAVVEALQKNASNRRQN

SEQ ID NO: 14420 - protein, 151 aa, Nostoc sp. PCC 7120
MSNWLEHSVQVEVEAPIDLVWGLWADLEQMPNWMKWIDSVKVPPENPDLSLWKLNTGGLEFTWKSRITKVITNQIIQWESIDGLPNQGAIRFYDRHGHSIVKMTISYAIPGFLGKIMDNLFLGKAVESTIQADLERFREYALNLHQSSVNR

SEQ ID NO: 14421 - protein, 257 aa, Zea mays
  unsure (1)..(257): unsure at all Xaa locations
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETXLRRREAGSTHGMLLLHKQKAIAEKIKDWSNVVLAXYEPVWAIGTGKVATPAQXAQEVHAXSLRDWVKINVSPEVSESTRIIYEGSVTAANCKELAAQXPDVDGFLVXGGASLKPEFIDIINAATV

SEQ ID NO: 14422 - protein, 400 aa, Zea mays
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHIPPGENALSDVLLSTPIFTGEEGGSGFAASAAAAAATGASGFEFGVDPNVDPELALALRLSMEEERARQEAIAKKAAEDTSNTEHNNVPSSNSDSVMAEGEPASNAAAGDKEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDTSDKTEDEKN

SEQ ID NO: 14423 - protein, 410 aa, Microbulbifer degradans 2-40
MKTISEARADILARATPLAKTEHVNLFDGVGRILAEDCIAAIDVPPQANSAMDGFALELASVESEQLAGKTDIKLNVSQRIPAGTAPQPLHAGTAARIFTGAVVPSNSNLVVMQENCTYNQQAQTVTIHLDKFTPSLNANIRPQGQDIAKGKVLYNKGHILRPQDLGILASVGVGKVNVVAKPKVALISTGDELVDPASGTPLQAGQIYNSNKPMLQALLNQLGCEVVDLGTIEDTPEDVARALSQAADVADFIVSTGGVSVGEEDHIKGVVEALGELQLWKIKIKPGKPLAFGHVKNTLFMGLPGNPVSAFVTFLLFGAPLIRKQLGVAQLFPSAAYIPANFTIDKPRQRPEFARAKVINGKVELYQNQSSGVLASVAWADTLVKIPEDTTISVGTPLEAYSIAALTQL

SEQ ID NO: 14424 - protein, 181 aa, Rhizobium galegae
MTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 14425 - protein, 611 aa, Chloroflexus aurantiacus
MREPISVQVTDTTNAVPRPTEPPRFRPRERFLRVSSFFLGVVIHIYIWDIFLARFAIFRWYVQRTMLRRWVSIARRFRMMAVELGGMQIKLGQFLSSRADIIPDVVRRELTGLQDEVPPAPAGHVLEVILEELGAPPSEIFRSFETDCVAAASLGQVHYAVLHDGREVAVKVQRPWIDKIVEVDLSAVTWVVRLIKNYPPIRRRADLEALLAEFARVLVQELDYVQEARSAATFRQNFANHPGIYIPEPIFELTTRRVLVMERINGIKITDLHTLDQLGVSRVELAARLNNCYLKQFFIDGFFHADPHPGNLFVRVETALAPVQPSPPVTSVSRNGHLSMDAVEAGLPIDTPPDEVPAGTPFTLIFVDFGMVGRLPPQTMEIMRQGVLGLATNDADRILNCLEQLNMILPGADRRAIKTAIETMLRYSFNRTVRELTNLDVEAIMAETKDLIYDLPFQIPQDLLYLGRALSMVAGLATEICPDINLFHELRPFARAMLAQEQRNGNWVEKLQQELTELGQILIGLPRQMDAYYRAANRGELQTRSDLSRLERSMKRVERATDRLMGGMLATGLFLGGVQLRTRGLEREANRAWWAAAAAIVWALWPRNERW

SEQ ID NO: 14426 - protein, 765 aa, Luffa cylindrica
MWQLKIGADTVPADPSNAGGWLSSLNNHVGRQVWHFHPELGTPEDLQQIQHARQRFSDHRFEKKHSADLLMRMQFAKNNSSFVNLPQIKVKDKEDVTEEAVSRTLRRAINFYSTIQGDDGHWPGDYGGPMFLIPGLVITLSITGALNAVLSTEHQREICRYLYNHQNKDGGWGLHIEGPSTMFGSVLNYVSLRLLGEEAEDGQGAVDKARKWILDHGGASAITSWGKMWLSVLGVYEWAGNNPLPPELWLLPYLLPFHPGRMWCHCRMVYLPMCYLYGKRFVGPITPIIRSLRKELYLVPYHEVDWNKARNECAKEDLYYPHPLVQDIVWASLHHVYEPLFMRWPAKRLREKALQCVMQHIHYEDENTRYICIGPVNKVLNMLCCWVEDPHSEAFKLHIPRIFDYLWIAEDGMKMQGYNGSQLWDTAFAVQAIMSTKLAEEYGTTLRKAHKYIKDSQVLEDCPGDLQSWYRHISKGAWPFSTADHGWPISDCTAEGLKAVLLLSKLPSEIVGKSIDEEQIYDAVNVILSLQNTDGGFATYELTRSYPWLELMNPAETFGDIVIDYTYVECTSAAIQALVAFKKLYPGHRRDEIDNCVAKAADFIESIQATDGSWYGSWGVCFTYGGWFGIRGLVAAGRRYDNCSSLRKACDFLLSKELASGGWGESYLSGQNKVYTNIKDDRPHIVNTGWAMLSLIDAGQSERDPTPLHRAARILINSQMDDGDFPQEEIMGIFNKNCMISYAAYRNIFPIWALGEYRCRVLQAP

SEQ ID NO: 14427 - protein, 400 aa, Triticum aestivum
  unsure (1)..(400): unsure at all Xaa locations
KIFRQFRSPHHRQSPWDPQVSLEPSCFCSSELALFYENGPFHIADNMSLLWNDFGWDQESNLIYVDQPTGTGFSYSSDSRDTRHNEASVSNDLYDFLQAFFKEHPEYVENDFYITGESYAGHYIPAFATRVYKXGNKNNEGIHINLKGFAIGNGLTDPAIQYKAYTDYALDMGXLITQSEFTKINKIVPACEFAVKVGGTSGTVSCFAAYFVCNTIFSSIRLILGSKNYYDVRKPCVGSLCYDFSNLEKFLNLKSVRQSLGVGDIEFVSCSPTVYQAMLLDWMRNLEVGIPELLENDIKVLIYAGEYDLICNWLGNSRWVDSMEWSGKKAFVSSTEKPFMVDGKEAGVLKSHGPLSFLKVHDSGHMVPMDQPKAALEMLKRWTSGNLSDASGSQRLDFAM

SEQ ID NO: 14428 - protein, 316 aa, Salmonella typhimurium LT2
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDARLSFDKEKSIEKARHLVDLYQQQGVDKSRILIKLAATWEGIRAAGQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTPMTEAEFRWEHNQDAMAVEKLSEGIRLFAVDQRKLEDLLAAKL

SEQ ID NO: 14429 - protein, 399 aa, Oryza sativa
MALSISTPPTSSSLLPASLQVGRWSSSAAMSARPVAFSLRRPVLAARVAAGGNAPSSSVDEVVTELDAVASFSEVVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALVKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 14430 - protein, 158 aa, Escherichia coli
MKLISNDLRDGDKLPHRHVFNGMGYDGDNISPHLAWDEVPAGTKSFVVTCYDPDAPTGSGWWHWVVVNLPADTRVLPQGFGSGLVAMPDGVLQTRTDFGKTGYDGAAPPKGETHRYIFTVHALDVERIDVDEGASGAMVGFNVHFHSLASASITAMFS

SEQ ID NO: 14431 - protein, 354 aa, Ustilago hordei
MGNCLSSSDQKEAKDRSVAIDKQIEQDSRQFKKECKILLLGSGESGKSTIVKQMKIIHQNGYSKDELLLYRLTVIKNLVDSAQAIVLALRKFKMEPEMPENRENVDVILQYRVDADPGATLDHPMARKVDSLWKDPIIPAIMERSSEFYLMDSAAYFFDNVNRIGQADYVPDENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 14432 - protein, 360 aa, Pisum sativum
MDFSTNGSEESELYHAQIHLYKHVYNFVSSMALKSAMELGIADAIHNHGKPMTLPELSSSLKLHPSKVNILYRFLRLLTHNGFFAKTTVKSNEGEEETAYVLTPSSKLLVSGKSTCLSSLVKGALHPSSLDMWGVSKKWFHEDKEQTLFECATGENYWDFLNKDSDSLSMFQDAMAADSRLFKLAIQENKHVFEGLESLVDVAGGTGGVAKLIHEAFPHIKCTVFDQPQVVGNLTGNENLNFVGGDMFKSVPSADAVLLKWVLHDWNDELSLKILKNSKEAISHKGKDGKVIIIDISIDENSDDRGLTELQLEYDVVMLTMFLGKERTKKEWEKLIYDAGFSRYKITPICGFKSLIEVYP

SEQ ID NO: 14433 - protein, 518 aa, Oryza sativa; identical to SEQ ID NO: 2255

SEQ ID NO: 14434 - protein, 419 aa, Pyrobaculum aerophilum str. IM2 [sequence omitted]

SEQ ID NO: 14435 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGDQGVVECAYVEGVGQYARFFSQPLLLGKNGVEERKSIGTLSA

SEQ ID NO: 14436 - protein, 205 aa, Triticum aestivum
  unsure (1)..(205): unsure at all Xaa locations
MQCSLLLVHGASGAMYQTLERTAGTSSVLAIDPKHLQAENEMRRIFGSKVVXHFENQRNMPGTSRQVRGVRRAGLNPRRTLLVSPPGFWPAWDKSMSMDLVETKGSLNYFRYVYDPSVSHVQELFEAAKSANDLNAIAAILAKYPYHPDSLLTFADLFKYSGEHQSSADAVEKCLFALECAWHPLFNPLQGNYQLKYSHDLNKPF

SEQ ID NO: 14437 - protein, 186 aa, Magnetospirillum magneticum
  unsure (1)..(186): unsure at all Xaa locations
KVLSMELHHPELTYAAIVGLAAVLCGGMMTRLKQPXVVGYILAGVVLGPSGFGLVSXRDAVATLGEFGVLXLLFDIGMKLDIIRFLEVWKTAIFTTVLQIAGSVGTALLLRHGLGWSLGLAVVLGCAVAVSSTAVVIKVLESSDELDTPVGRHNLGILIAQNMAVVPMMLVLEFLXTKRLLPADMA

SEQ ID NO: 14438 - protein, 161 aa, Zea mays
MGSEGSSGPVVVPRNFRLLEELERGEKGIGDGTVSYGMDDADDIFMRSWTGTIIGPPNTVHEGRIYQLKLFCDTDYPDKPPTVRFQTRINMTCVNQETGLVEPSLFPMLGKWEREHTMEDILTSLKREMSTPQNRRLYQPHEGNEDQRVEQKGVSLRCVIM

SEQ ID NO: 14439 - protein, 593 aa, Schizosaccharomyces pombe
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFL

SEQ ID NO: 14440 - protein, 237 aa, Glycine max; identical to SEQ ID NO: 1765

SEQ ID NO: 14441 - protein, 537 aa, Oryza sativa
LGQGGFGPVFRGALPPGGTPFARAVMDAAGSLQGEREFHNEIAVASHLLASPFAYSMSSAARGEGRPRRMMLVYDLMPNGSLQDALLGRRCPELVAEWPRRLAVARDVAAALHYLHSVVKPPVVHGDVKPSNVLLDTDLRARLADFGLSRINSDADADGKPESGAIAEGCDVDGGCDDDASVIAESTVTTTVNGEGNPKSPEDDDGFTSASPAEAASTSGFDRTSVESGMNSRSCNGGGSRTGGTMGSGTGSDWWWKQDNGGGSNGVKDYVMEWIRSEIKKERPKNDWIAGAAITNPAADRKKPKRRAREWWREEYADELAKKQKRRALAKSKGRSKWSMMKSWSRRSNGSTGNGNGNGNGSINWWVNGARSTRDWASGEFVPKSSGAVSSTPSMRGTVCYVAPEYGGGGPLSERCDIYSYGVLLLVLISGRRPLQVTASPMSEFEKASLISWAKHLARVSRLIDLVDPALQDVNRDEVLLCITVALLCIQRSPARRPSSEEVLRMLSGEGEPPHLPLEFSPSPPGGFPFKSRKKVR

SEQ ID NO: 14442 - protein, 218 aa, Oceanobacillus iheyensis HTE831
MTKIAPSILSADFAKLGQEIKEVEEAGADYIHVDVMDGHFVPNITIGPLVVEAIRPITDLPLDVHLMIENPDAYIPAFAEAGASIITVHQEACVHLHRTLQLIRSHGVKPGVVINPATPVEMIKPILAEVDLILIMTVNPGFGGQSFIQETTSKIKQLADWREKYKLSYEIEVDGGVNEKTAGICTTSGADVLVAGSAIFNHENRKQAIELLREKAKV

SEQ ID NO: 14443 - protein, 219 aa, Zea mays
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENIRRWLKELRDHADSNTRIMLVGNKTDLRHLRAVATDDARSFAEAEGLSYIETSALEATNVEEAFQLILGDIYRAVSKKPVASDEAGAGQGGVKEGKTIDVATGADAAAHKKQCCSA

SEQ ID NO: 14444 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLGAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 14445 - protein, 374 aa, Photobacterium profundum
MSIEQLARKTVRELTPYQSARRLGGSGDIWLNANESPFANEYSVTCGRLNRYSECQPADLIQAYADYAGIDSKQVLTSRGADEGIELLIRTFCEPNQDSILYCPPTYGMYAISAETFDIKTKTVPLTPEWQLDLPSIQNNLDGVKLVFVCSPNNPTGNVMNRRDIEKLLDMTTDKALVVIDEAYIDFCLETSTVDLLAKYPHLVILRTLSKAFALAGLRCGFTLANTDVINLLLKVIAPYPVPVPVADIAVQALSVAGRARTKFQVLDISANRAYLQAGLGMLSGVTVYDGYGNYLLVKFTHADALFTALWNHGIILRRSPIENCIRISVGNRDECEKTLAFIRAHVTSQGNSSQDSASKSNSSANNDELNASN

SEQ ID NO: 14446 - protein, 474 aa, Acrosorium polyneurum
RYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTIIVMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFQQDWASLRKVTPVASGGIHCGQMHQLLDYLGNDVVLQFGGGTIGHPDGIQAGATANRVALESMVIARNEGIDYVSEGPQILRDAAKTCGPLQTALDLWKDITFNYTSTDTADFVETPTANV

SEQ ID NO: 14447 - protein, 292 aa, Salmonella typhimurium
MCTPRGLTPPWFFIVLIGQKLMESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRIWYFMSARCSSLCLSIRGIRSAQTAVHLC

SEQ ID NO: 14448 - protein, 275 aa, Escherichia sp. Souza-273
IGQALALLLKTQLPSGSELSLYDIAPVTPGVAVDLSHIPTDVKIKGFSGEDATPALEGADVVLISAGVARKPGMDRSDLFNVNAGIVKNLVQQIAKTSPQACIGIITNPVNTTVAIAAEVLKKAGVYDKNKLFGVTTLDIIRSNTFVAELKGKSSSDVEVPVIGGHSGVTILPLLSQIAGVSFSEQEVADLTKRIQNAGTEVVEAKAGGGSATLSMGQAAARFGLSLVRAMQGEKGVVECAYVEGDGQYARFFSQPLLLGKNGVEERRSIGTLSA

SEQ ID NO: 14449 - protein, 266 aa, Zea mays
MNGLLVLFFAYPLQAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 14450 - protein, 496 aa, Zea mays
ITMDPTKFRPSSSHDTTVTTTNAGAPVWNDNEALTVGPRGPILLEDYHLIEKVAHFARERIPERVVHARGASAEGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 14451 - protein, 270 aa, Zea mays
TRPRTWRTRGGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIDHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 14452 - protein, 294 aa, Salmonella typhimurium
IVFRAAQKRSDIEIVAINDLLDAEYMAYMLKYDSTHGRFDGTVEVKDGHLIVNGKKIRVTAERDPANLKWDEVGVDVVADATVIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLV

SEQ ID NO: 14453 - protein, 693 aa, Zea mays
SSRKEFEEMSEQYVAVTKKEKRRRACYRCGKRKWESKESCLVCDARYCGYCVLRMMGSMPEGRKCVNCIGQPIDESKRSKLGKNSRTLSRLLSPLEVRQILKAEKECQANQLRPEQLIVNGCPLRPEELTDLLSCSRPPQKLKPGKYWYDKESGLWGKEGEKPDRIISSNLNFTGKLQVNASNGNTQVYMNGREITKIELKVLKVANVQCPRDTHFWVYDDGRYEEEGQNNIKGKIWESALARFACALFSLPVPPGNSNGTRDEVPYTARAVPDYLDQKRIQKLLLLGPPGAGTSTIFKQAKYLYGTRFTQEELEGIKLMIQSNMFKYLGILLEGRERFEEEALSRLNYTISQGEETQHDENKANGSNSCIYSINARLKKFSDWLLDIIAMGDLDAFFPAATREYAPFVDEMWKDPAIQATFKRKEELHFLPDVAEHFLSRAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 14454 - protein, 198 aa, Sulfolobus acidocaldarius
YIIPDEIPYKAVVNIENIVATVTLDQTLDLYAMERSVPNVEYDPDQFPGLIFRLESPKITSLIFKSGKMVVTGAKSTDELIKAVKRIIKTLKKYGMQLTGKPKIQIQNIVASANLHVIVNLDKAAFLLENNMYEPEQFPGLIYRMDEPRVVLLIFSSGKMVITGAKREDEVHKAVKKIFDKLVELDCVKPVEEEELEF

SEQ ID NO: 14455 - protein, 464 aa, Pterocladiella caloglossoides
KMGYWDPDYAVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEGVNRATASTGEIKGHYMNVTAATMEDMYERAEFAKQLGTIIVMIDLVIGYTAIQTMAIWARKNDMILHLHRAGNSTYSRQKSHGMNFRVICKWMRMAGVDHIHAGTVVGKLEGDPLMIKGFYNTLLLTHLDVNLTQGIFFEQDWASLRKVTPVASGGIHCGQMHQLLDYLGEDVVLQFGGGTIGHPDGIQAGATANRVALEAIVIARNEGRDYVAEGPQILRDAAKTCGPLQTALDLWKDITFNYTSTDTADFVETPTANV

SEQ ID NO: 14456 - protein, 360 aa, Eremothecium gossypii
MARNIDLKTVTDWSVLIGTGISLYYLLHRLFNDADGPLASVSKESREKQSTTWRRLVEANPELSRVHLNSYEQNALASVVTPQDIDVSFSDIGGLETIIDELTESVIYPLTTPELYTQHSLLEAPRACLLYGRPGCGKTMIAKALARESVANFLSIRMSSIMDKWYGESNKIVDALFSLANKIQPCIIFIDEIDSFLRERASSDHEVTAMLKAEFMTLWDGLTSNGRIIVMGATNRITDIDSAFLRRLSKRFSVPLPNEPQRRKILDVILENVEVDPQDFDIDYLVKATRGLSGSELKELCRDAALNAAREYIRQKRQLSAKDASYEGKPLKVRPLQTRDFLKNLKLDATQPFVTSVALD

SEQ ID NO: 14457 - protein, 504 aa, Brucella melitensis 16M
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVEFMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 14458 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 14459 - protein, 462 aa, Zea mays
MFLLSCSSTATIPFSLSSPLQGPSHPHKAWTLGPAGGEEDKTNSAAGMMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPTQLIPNDDEGKVLRVKLIMKEGVDNFNPVYLFDEGSTISWVPCGRKLTCSYPGIKFAYGPDIYFGNEVSVLEMDGQFDRLDELIYVESHLSNLSTKFYGEVTQQMLKHADFPGSNNGTGLFQTIVGLKIRDLYEQIVAERAGAPAEAAKV

SEQ ID NO: 14460 - protein, 352 aa, Medicago sativa
MASSINGRKPSEIFKAQALLYKHIYAFIDSMSLKWAVGMNIPNIIHNHGKPISLSNLVSILQVPSSKIGNVRRLMRYLAHNGFFEIITKEEESYALTVASELLVRGSDLCLAPMVECVLDPTLSGSYHELKKWIYEEDLTLFGVTLGSGFWDFLDKNPEYNTSFNDAMASDSKLINLALRDCDFVFDGLESIVDVGGGTGTTAKIICETFPKLKCIVFDRPQVVENLSGSNNLTYVGGDMFTSIPNADAVLLKYILHNWTDKDCLRILKKCKEAVTNDGKRGKVTIIDMVINEKKDENQVTQIKLLMDVNMACLNGKERNEEEWKKLFIEAGFQHYKISPLTGFLSLIEIYP

SEQ ID NO: 14461 - protein, 480 aa, Acinetospora crinita
TRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLTGGLDFLKDDENINSQPFMRWKERFLYCMEGVNRAAAATGEVKGSYLNITAATMEEMYQRAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAAASCGPLKAALDLWKDITFDYTSTDTPDFVEVATESR

SEQ ID NO: 14462 - protein, 893 aa, Microbulbifer degradans 2-40
MNKHFLVGVITLGVILQGLTACSKSAAPNANQPQDTAASTATYPFRDASLSVDARVDDLVSRLTTTEKIAQMFNDTPAIERLGIPAYNWWNESLHGVARAGKATVYPQAIGLASTFDEDLMLRVATSISDEGRAKYHDFLSKDVRTIYGGLTFWSPNINIFRDPRWGRGQETYGEDPFLTGRMAINFVKGIQGENDNSDYLKAVATIKHYAVHSGPEKTRHSDDYHPTRKDLFETYLPAFRMAIAETNVQSLMCAYNRVDGAPACGNNELMQEILRGDMGFNGYVVSDCGAIADFYESRSHHVVDSPAEAAAWAVKSGTDLNCGDSHGNTYTNLHYALQQGLITEDYIDIAVKRLFKARIKLGMFDEQDRVPYSEIGMDVVGSPKHLALTQEAAEKSIVLLKNNGVLPLKAGVKVAVIGPNAVDEDVLVGNYHGVPVKPVLPLEGIVNRVGEANVFYAPGSAQIADIYSHYEPISAENFYHKDANGNLAAGLKAEYYADYYNAAEINDDTFSATPALNRIDADINFSWPVSPIDNSLDDEFSAVWTGILKPKKSGSYRFSGTVALAINGKPVNGAVNLKAGESYNIKAIFGVQKWWPVNAIHPYGKLTWLDESRDLEEEALAAARKADVIIFMGGIDAHLEGEEMPLELDGFTHGDRTHINLPKVQTNLLKQLKATGKPVVMVNFSGSAMALNWESEKLDAILQAFYPGEATGTALANILWGDVSPSGRLPVTFYKGVDDLPAFNDYHMENRTYKFYRGEPLYAFGHGLGYVDFAYNNLVVANTAEAGKALPIAVSVTNTGKMQAEDVAQVYISLLDAPANTPIRDLKAFKRTKLAAGESTELEFNLPARVLTYIDDNGKTQTYTGRVEVTVGSGQKGYVKENAIAVATINVQ

SEQ ID NO: 14463 - protein, 251 aa, Zea mays
IGYLEAGRGSAPQLALLTNSKPTDSSPHRARQTRIVFVVVVAKRHTSGGVGGHVQRAHLPTRLPPHRLPPRHLQLRPVALLFLPLTTSPSSPSLPLVLLATEQATNQASDTDRELHRSGDRHARKAPAAHDGNGNGGGGGRAAPKGCVTVRVGLEGEEQRRFAVPLGHLKHPLFGALLEEAEREYGFRHQGALAIPCRVDRFVQLERLIGRDLHGACAHHLVDLDGAAAAAAQHQHQHHLHLPRFVGCFRA

SEQ ID NO: 14464 - protein, 359 aa, Arabidopsis thaliana
MGNSSEEPKPPTKSDKPSSPPVDQTNVHVYPDWAAMQAYYGPRVAMPPYYNSAMAASGHPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 14465 - protein, 471 aa, Arabidopsis thaliana
MASLLIFPHLHHFDSSLDRREVLVVRHSQASRRFLTPKASINGSGITNGAAAETTSKPSRKGRKKKQTSTVIEKDNTETDPELNPELADYDDGIEFPYDDPPLVCCFGAVQKEFVPVVRVHDNPMHPDMYSQWKMLQWDPPEFGRAPGGPPSNVAISHVRLGGRAAFMGKVGEDDFGDELVLMMNQERVQTRAVKFDENSKTACTRVKIKFKDGKMMAETVKEPPEDSLFASELNLAVLKEARIFHFNSEVLTSPTMQSTLFTAIQWSKKFGGLIFFDLNLPLPLWRSRNETRKLIKKAWNEANIIEVSQQELEFLLDEDYYERRRNYTPQYFAEDFDQTKNRRDYYHYTPEEIKSLWHDKLKLLVVTDGTLRLHYYTPTFDGVVIGTEDVLITPFTCDRTGSGDAVVAGIMRKLTTCPEMFEDQDVMERQLRFAVAAGIIAQWTIGAVRGFPTESATQNLKEQVYVPSMW

SEQ ID NO: 14466 - protein, 347 aa, Flaveria linearis
YIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKAIKPTVLIGSSGAGQTFTKEVVEAMRSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 14467 - protein, 371 aa, Oryza sativa
GYNGSQLWDTAFTVQAILATNLIEDFGPTIKLAHGYIKNSQLLHDCPGDLSYRYRHIYKGAWTFSTADQGWAVSDSTAEGLKASLLLSKISLEIVGEPLKVNRLYDAVNCLLSWMNNNGGFATYELTRSYAWLEILNPSETFGDIMIDYPNRKCELNSTGSYVECTSGVIQGLTAFRKHYPGHRREEIDNCIQKADSFIQSIQRSDGSWYGSWAVCFTSRTWFGAKGLIAAGRTYENCPAIRKACNFLLSKELPCGGWGESHLSCKGKVYTNLEGERPHGVNTSWAMLALIDAGQGERDPAPLHRAARILINLQLEDGEFPQQEIIGAFSKNCAISYSQYRNIFPIWALGEYRCRVLLGRQDASVTGNTAS

SEQ ID NO: 14468 - protein, 186 aa, Halobacterium sp. NRC-1
MTDPKETINIENVVASTGIGQELDLQSVAMDLEGADYDPEQFPGLVYRTQDPKSAALIFRSGKIVCTGAKSTDDVHESLRIVFDKLRELSIKVEDDPEIVVQNIVTSADLGRQLNLNAIAIGLGLENIEYEPEQFPGLVYRLDDPEVVALLFGSGKLVITGGKEPKDAEHAVDKITSRLEELGLLD

SEQ ID NO: 14469 - protein, 266 aa, Oryza sativa
MKNKIKLQSLVGHGGSVNEIKSQPSNPSLIISASKDESIKLWNVQTGILILVFGGVGGHRHEVLGVDFHTSDIYRFLSCGMDNTVRIWSMKEFWEYVEKSYSWTDATSKFPTKFVQFPVLCAEIHSNYVDCTKWLGDFVLSKSVENEILLWESITKEENPGEGHIDVLQKYPVPECNIWFMKFSCDFHHNQLAIGNRDGKVYVWKVQTSPPVLIARLNNPQVKSAIRQTAVSFDGSTILACTEDGNIWRWDEVDHPTAPVPSKKQK

SEQ ID NO: 14470 - protein, 475 aa, Lycopersicon esculentum
MRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKFKSVATLSSPKPVQSLF

SEQ ID NO: 14471 - protein, 457 aa, Zea mays
MPPSKARRKRSLRDITATVATGPVANSKPGSSSTNEGKQHDKKKEGPQEPDIPPLPPVVVNIVPRQGLGCEVVEGLLVPSRKREYKPNSKYTVGNHPIYAIGFNFIDMRYYDVFAIASCNSVIIYRCLENGGFGLLQNYVDEDKDESFYTLSWTIDQVDSSPLLVAAGSNRIIRVINCATEKLDKSLVGHGGSIHEIRTHASKPSLIISASKDESIRLWNVHTGICILVFAGAGGHRHDVLSVDFHPTEVGIFASCGMDNTVKIWSMKEFWIYVEKSYSWTGHPSKFPTRNIQFPVLTAAVHSDYVDCTRWLGDFILSKSVKNAVLLWEPKPDKRRPGEGSVDVLQKYPVPKCSLWFMKFSCDFYSNQMAIGNNKGEIYVWEVQSSPPVLIDRLCNQECKSPIRQTAVSFDGSTILGAADDGAIWRWDEVDPAASSSKPDQAAAPAAGAGADADADA

SEQ ID NO: 14472 - protein, 352 aa, Zea mays
  unsure (1)..(352): unsure at all Xaa locations
MDQSFGNLGAGAGSSSGGSNSKAAAAAVSSSSFLQLPLSTASPAYYGAPLALLHHAAAAPSSSQQHQQQQHHHHYARHGAEMSAAEAEAIKAKIVAHPQYSALLAAYLDCQKVGAPPDVLERLTAMAAKLDAPAAXGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 14473 - protein, 651 aa, Oryza sativa
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVGCDIQKDSVVLKSSEHIGPAEIGLLATVGVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 14474 - protein, 441 aa, Ferroplasma acidarmanus
MQDEESFIEKLKKDEVEFLQLQFTDISGSVKSLTIPHNRFEDVIYNGVMFDGSSIVGYKQIEDSDMKAVPELSSYTILTNENYAGKTVRFVCKIFNSDGTRFEGDPRYILEKQVEKLTKENKTYYLGPELEYFLFKQDENGEPTIEPSDYGGYFDKEPLDRAFTVKQEIIRKLEGLHYYPEASHHEVAYSQHEIDVKYSDAVTMADRIIMIKSVVKETANEYGYYATFMPKPVKGVNGNGMHVHQSIFSGDENLFYNESSKYGLSDYAMHYLGGILHNVADASLVLASTVNSYKRLVPGYEAPVYIAWANRNRSALVRIPAAPPKGKRMELRFPDAAGNQYLQFAAILGMGLDGIENKINPPEAIEKNIFEMDLAERQKNGIKSMPGSLGQAIESFRNSELMKKIFGESVFNNLLRIKENEWNEFRSEVTDWEINKYLDIY

SEQ ID NO: 14475 - protein, 243 aa, Zea mays
RHTHERRNPTRPPRTTAPTMDAGAARPSAPSTAAVAGASVADEPRDARVVRELLRSMGLREGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEETEDETEEPNPSNPANSNPSYSQDQSSKEQQQQHTPQHGQRVSFQLNAVAAAAAAAKRPRMTIDQLNMG

SEQ ID NO: 14476 - protein, 490 aa, Zea mays
MPDKAVDDVMEAAVGAHFSGLRLEALRLSTSAPSSPSSSPAAAAHTHSNGAVYANGTTELPSPAAARQPFVIGVSGGTASGKTTVCDMIIQQLHDHRVVLVNQDSFYRGLTAEESAHAQDYNFDHPDAFDTEQLLECMGQLKCAQPVNVPIYDFKKHRRCSESFRKVNASDVIILEGILVFHDQRVRNLMDMKIFVDTDADIRLARRIRRDTVERGRDISSVLDQYGRFVKPAFDDFVLPSKKYADVIIPRGGDNHVAVDLIVQHIRTKLGQHDLCKIYPNVHVVQSTFQIRGMHTLIRDRDITTPDFVFYSDRLIRLVVEHGLGHLPFTEKQVITPTGSVYMGVDFCKKLCGVSIVRSGESMENALRACCKGIKIGKILIHRVGDNGQQLVYHKLPMDIAERHVLLLDPVLGTGNSVAQAIDLLIRKGVPEDRIIFLNLISAPEGIQCICKRFPSLKIVTSEIDYGLNEEFRVIPGLGEYGDRYFGTDN

SEQ ID NO: 14477 - protein, 511 aa, Streptomyces coelicolor A3(2)
MHNPGNATPDRFPAQDRFADGAQYIAGRLTKGTSGRTHTVVDPATGEDVLTYDLAGPDDVDAAVAAARAAFPGWAGATPGERSDALHRFAAVLAERAEDFARAESLQCGKPLKLTREFDVPGTVDNAAFFAGAARHLQGQSAGEYSGDHTSYVRREPIGVVGSIAPWNYPLQMAAWKILPAIAAGNTIVLKPAEITPLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 14478 - protein, 332 aa, Oryza sativa
  unsure (1)..(332): unsure at all Xaa locations
MATVSGTDRLRDLHAFDDTKAGVKGLVDAGVTTVPYFFRHHPDPLPVAAPSEAASAIPLIDLAKADVDRGRVVAEVRTAAETVGFFQVVNHGVAGELMDEMLAAVRRFNEEPLEAKVPYYTRDVASKVRFNSNFDLFRSPAANWRDTMFVEMFPEVPSPEEIXPPPCKGVLEEYPAAVRRLGERLFELLSEALGLPAGTXSGGLQAVLPRPPEERWVDVPPVAGALVVNVGDLLQLVSNERLRSVEHRVLPTGAAGPARVSVACFFRLAYSSTRPCVPVVGGGSGARAAAVYRSTTAGEFLAHYNGKGLDGRSALDHFRIPAAAASPPPPPQ

SEQ ID NO: 14479 - protein, 550 aa, Schizosaccharomyces pombe
MSDIDKESLKQNQKQWENEVELGESREANQDDELLMSLGYKPEFTREFSYVSIFGQSFGSMGLCPAMAGSLIFSMNCGGGGMVWSWIIGCICLIPVSISLGELASSMPTSGGLYFWIFTLASPSSRAFLCWVCGYVSVLGYATIYASTVYSASSMVQALAVIGSPSYSPTKYEQYGIYAALLFVISAMTAIPSRVIAKVNIINITFQFLVSIILIIALAAGSDSTTRNSGSFIFGDFTNYSGWSNMGWAFILSFTTPVWVVSGFESSAAVAEESTNAAKAAPFAMISSLGVATILGWCIVITVVATMGHDFNAILGSSLGQPVAQVLVNNVGNKGALGIFSLLVIALCLNCISLLIAASREVFAFCRDGGIPGSRYLRLLTKQKVPLNAILLVLLYSLLVGLLILVNVTAISSVFNLAIIALYIAYSGPLMCRFVYNKFQPGVFYVGKWSKPAALWSLVWMWFMILMLLFPQYQKPNQDEMNWAIVVLGFVMVFCVVYYYLPKIGGKTFFTGPIPTVQQENEYISGVPLNELSLSSLPLPKDFDQKQITE

SEQ ID NO: 14480 - protein, 420 aa, Triticum aestivum
  unsure (1)..(420): unsure at all Xaa locations
MEGPSVEVPPYFLCPISLEIMRDPVTLATGITYDRCSIERWLSDGHATCPITQQKLAEADREATPNHTLRRLTQAWCALHAVERFPTPRPPLDACRVAEIVEEGRGAGRQKELAALREIKAIVAESDRNRRCVEATPGAVEFLVSVVRNHATASKSAEDLSELSLDSPTSTSSPEEDALSVICSLKPSKKSLVRILEENRDFLXPLVCMLRRPSYRSRCYGILLLKAMVSVMEPARLMAVRTEVVQELVRVVSDRVSPRARKAALHVLCRLCPWGRNRVKAVEAGAMTVLVELLLDEGGRHPTELAVVAIDHLCGCAEGRSDLVAHPAGLAVVAKKAMRVSLTTTESAVRALHAVARHSPTPAVLQEMLAVGVVAKLLLVLQVDAGERARAKAKELLKMHARVWKDSPCLQAHLKAHYPC

SEQ ID NO: 14481 - protein, 243 aa, Triticum aestivum
CAWLEIQSLCTSSDILNNLNLKNHWMKDFFIASAHLELKMHEEALKRYERLMGVFRCSDYIQAQIATVQYSMRDLDEADMIFEELLRTDPFRVDSMDIYSNLLYAKESLTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYALYYFRKSSHLQPNDARLWIAMAQCYESDP

SEQ ID NO: 14482 - protein, 245 aa, Nothotsuga longibracteata
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHGGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNG

SEQ ID NO: 14483 - protein, 765 aa, Salmonella typhimurium LT2
MKWLCSVGVAVSLAMQPALAENLFGNHPLTPEARDAFVTDLLKKMTVDEKIGQLRLISVGPDNPKEAIREMIKDGQVGAIFNTVTRQDIRQMQDQVMALSRLKIPLFFAYDVVHGQRTVFPISLGLASSFNLDAVRTVGRVSAYEAADDGLNMTWAPMVDVSRDPRWGRASEGFGEDTYLTSIMGETMVKAMQGKSPADRYSVMTSVKHFAAYGAVEGGKEYNTVDMSSQRLFNDYMPPYKAGLDAGSGAVMVALNSLNGTPATSDSWLLKDVLRDEWGFKGITVSDHGAIKELIKHGTAADPEDAVRVALKAGVDMSMADEYYSKYLPGLIKSGKVTMAELDDATRHVLNVKYDMGLFNDPYSHLGPKESDPVDTNAESRLHRKEAREVARESVVLLKNRLETLPLKKSGTIAVVGPLADSQRDVMGSWSAAGVANQSVTVLAGIQNAVGDGAKILYAKGANITNDKGIVDFLNLYEEAVKIDPRSPQAMIDEAVQAAKQADVVVAVVGESQGMAHEASSRTNITIPQSQRDLITALKATGKPLVLVLMNGRPLALVKEDQQADAILETWFAGTEGGNAIADVLFGDYNPSGKLPISFPRSVGQIPVYYSHLNTGRPYNPEKPNKYTSRYFDEANGPLYPFGYGLSYTTFTVSDVTLSSPTMQRDGKVTASVEVTNTGKREGATVIQMYLQDVTASMSRPVKQLKGFEKITLKPGERKTVSFPIDIEALKFWNQQMKYDAEPGKFNVFIGVDSARVKQGSFELL

SEQ ID NO: 14484 - protein, 396 aa, Methanosarcina mazei Goe1
MGRIFKERTSVDEALELFFESFSSLSHTEEVPLEACTGRVLAEPVISGRDVPHYRRAAMDGYAVRSSDTSGASPSNPVFLQLSDCVEEGTAMWVHTGAVLPEGADAVVVVEDTVTAGNMVEIRAQVHPGKNVGQAGEDIKKENLVFKEGHLLRPCDAAVLASLGLDMAKVFRKPVVVVIPTGDELVSREKAGQVPPPGMVLETNGLMTALYVEKWGGVPRHTGIVPDRPESIKEAIEANLDADMILLSGGTSVGKRDHAPEVVESLGKLLVHGVAVSPGKPAALGVIGKTPVVCLPGYPVAGLVALYFFVRPGIRKLGSIPKVPEFVFRRRLAAKISSKIGYVNFVRVVFEGDKIRPLTGKAGVLSSVAKADGYVLVPENIEGYEEGQEVDVFLIE

SEQ ID NO: 14485 - protein, 378 aa, Caulobacter crescentus CB15
MERGRMLVLDRKPLTPAWASPMRQALEGVQGYKAGMTLAEAARRTGLSAFSKLASNENLLGPSPKVAEAVMAAMAEPHIYPDPHSDVLRAAIGARLGVSPARVVVSPGSEALIDYVFRAVLHPGDSILLSSPTFPTYEIFGRCAEARIIDVPRLANFDIDVPAVCAAAALGPKLLVLCTPNNPTGNALKAADFQAILAATPRSTVVFVDEAYREYHEAFDTFAMLDAWGGPWVSARTFSKAYGLAGLRMGYGVASSPELVDYLDRIRPPFNVTAVSQAAALAAWEDQDYLKRTVDLTIAERGRVEAVLDDMGVEHTESHANFVFLRSPAGPEATAAHLLHQGLIIRPTPVAGGWVRITIGRPADNDALIAALPAALSL

SEQ ID NO: 14486 - protein, 141 aa, Oryza sativa; identical to SEQ ID NO: 3055

SEQ ID NO: 14487 - protein, 470 aa, Shigella flexneri 2a str. 301
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 14488 - protein, 196 aa, Mitthyridium sp. Efate and Streimann 63086
GGAKKVVISAPSKDAPMFVMGVNEDKYTNEDVVSNASCTTNCLAPLAKVINDKFGILEGLMTTVHATTATQKTVDGPSNKDWRGGRSASTNIIPSATGAAKAVGKVLPELNGKLTGMAFRVPTTDVSVVDLTVRLEKPASYNAIKAALKEASQGKMKGILGYTEDEVVSSDFITDSRSSIFDAKAGIALSDTFVKL

SEQ ID NO: 14489 - protein, 431 aa, Triticum aestivum
  unsure (1)..(431): unsure at all Xaa locations
MDATTAKQLRRLRTLGRGASGAVVWLASDDASGQLLAVKSAGAGAADTLRREGSVMAGLCSPHIVPCLGSRAAPGGEYQLFLEFAPRGSLADEAARSGGSLAERAIQGYAADVARGLAYLHGNSLVHGDVKARNVMVGADGRAKLADFGCARAADSDRTIGGTPAFMAPEVARGEEQGLAADVWALGCTVIEMATGRAPWSGMDDVFAAVHRIGYTDAVPEXPASLSPQAKDFLRKCFARNPRHRSTAAQLLEHPFLASAFRDVDAEPAKQDWVMSPESTLNADFWEXSDEESETEDMLTSAAERIXSLASPCSALPDWESDDGWIVVHGGRPEASETTTPTAIAGTDFGPWSEEGLEAEVDVHFAGADAGRWYDLVRNVDGAHYFGWYERDLGVSVVTDRPLCLIVSHGRKIVKFGCHCDRERTMHFDFA

SEQ ID NO: 14490 - protein, 99 aa, Glycine max
  unsure (1)..(99): unsure at all Xaa locations
ILAHGIKTLHLYTLNMEKSALAILMVNLGLIEESKVSRSLPWRRPANVFRVKEDVRPIFWANRPXSYISRTIGWDQYPHGRWGDSCNPSYGALSDYQVH

SEQ ID NO: 14491 - protein, 461 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMG

SEQ ID NO: 14492 - protein, 397 aa, Zea mays
MDGGGQPPDTEMTDAGAGGGGQPSPPQQPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPPLREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPCHARQSFPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 14493 - protein, 316 aa, Zea mays
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHVPPGENALSDVLLSTPIFTGEEGGSGFAASAAAAVATGASGFEFGVDPNVDPELALALRLSMEEERARQEAIAKKAAEDTSNTENINASSSNSDSVMAEAELASNAAAGDKQEQPKPQDDDDLLQQALAMSMEGGASGSAGGSL

SEQ ID NO: 14494 - protein, 306 aa, Desulfovibrio vulgaris subsp. vulgaris (strain Hildenborough)
MNVRLRAYIHLTLAMCIAGSAVVAGKLMVSSMPVFLAAEAGLLASLAVQVPFTFMMKRERIPADLSVHLYLVLQALFGVVLYRVFIFQGLQHTTATVGGVISSTTPLCIVLLSAIFLREHITRRTIAGAVCVVTGLATISLTPLMDATPAATGSFTGNVLILAAVVSESAFSVMSRAKRDHLSPLARTAMVSVYAALCLLPFAIHDALHYDMATLDAETLSCIAYYGVFVSFLSYLLWFKGVAVIAAGTAASFTGLIPLSSMGIAWLVLNETITSAHIAGLACVGAGIVIACIRPATSPTTSSVAV

SEQ ID NO: 14495 - protein, 617 aa, Bacillus cereus ATCC 14579
MLLYEKVHEEIARRTTALQTMQRQDGTWRFCFEGAPLTDCHMIFLLKLLGKDKEIEPFVKRLASLQTNEGTWKLYEDEVGGNLSATIQSYAALLASKKYTKEDVNMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYALQEAQVPKASKVIHNASAYLLRKQQTKKVDWSVHAPDLFPGGWGFSDVNTTIPDIDDTTAALRALARSRGNENVDTAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 14496 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 14497 - protein, 462 aa, Mycobacterium tuberculosis CDC1551
MIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 14498 - protein, 662 aa, GIBBERELLA ZEAE PH-1
MASFMSSFFPGGKAANASGENSTSRPATPSTKLDNFLNPVSTPQGSPSKKTNPPGAHDLPSAFESALNLNNPTIEPPLRLGRPQSVVTPLAPGKTKTQPLDESSPNVDESVVHKSRPGSPNKKQGQENTPPTSRLATLESPHQHSHAAVTRQQLYEQRDRPTTPATKRFNTHRGLTAEEREILQKPNVKRLVNVTQLYFLDYYFDLLTYVGARQNRLQAFKNEYPPPPETDEQTHNQMWAKYAGRERANLRKRRVRLRHGDFQILTQVGQGGYGQVFLAQKKDTREVCALKVMSKKLLFKLDEVRHVLTERDILTTAQSEWLVRLLYSFQDERSIYLAMEYVPGGDFRTLLNNTGVLSNRHARFYIAEMFCSVDALHQLGYIHRDLKPENFLVDSTGHIKLTDFGLAAGVLAPSKIESMRVKLEKASESSVPFGKPMDQRTVAERRESYRTMRENDVNYAKSIVGSPDYMAPEVLRGEEYDFTVDYWSLGCMLFEALTGFPPFAGATPDETWRNLKHWKEVLKRPVWEDPNYFLSNRTWNFICTCINSRSRRFSNITDIFAHQYFAEVEWDVLRQTRAPFVPELDSETDAGYFDDFTNEADMAKYKEVHDKQQALETMAEREDQMSKSLFVGFTFRHRKPATEDGASPRKRIPTDESFGTMF

SEQ ID NO: 14499 - protein, 405 aa, Yarrowia lipolytica
MEPETKKTKTDSKKIVLLGGDFCGPEVIAEAVKVLKSVAEASGTEFVFEDRLIGGAAIEKEGEPITDATLDICRKADSIMLGAVGGAANTVWTTPDGRTDVRPEQGLLKLRKDLNLYANLRPCQLLSPKLADLSPIRNVEGTDFIIVRELVGGIYFGERKEDDGSGVASDTETYSVPEVERIARMAAFLALQHNPPLPVWSLDKANVLASSRLWRKTVTRVLKDEFPQLELNHQLIDSAAMILIKQPSKMNGIIITTNMFGDIISDEASVIPGSLGLLPSASLASLPDTNEAFGLYEPCHGSAPDLGKQKVNPIATILSAAMMLKFSLNMKPAGDAVEAAVKESVEAGITTADIGGSSSTSEVGDLLPTRSRSCSRRSKSFLRRIDGRSKLTRLRVGLPAGSASV

SEQ ID NO: 14500 - protein, 280 aa, ASPERGILLUS NIDULANS FGSC A4
MAIPYATGLPADNQPLPSFRELLPPHLHEEIESTSYFNSQHNSRQPRERPASSHELGLNSVPREHASSRSSRPSPVLPPIRDLQSYPDRATGVYPDPRGLPPPPEITARPVGPHGYPHAAPAVPGPLADRNADAYRGVPPMHGQVRYHYPSMAYQSDPDHASVPSLSHAPQSNFGILGDSTDARNRRRRGNLPKPVTEILKAWFHAHLDHPYPSEEDKQMLMSRTGLTINQISNWFINARRRHLPALRNQRRTGGSDLDERQSLSDMEQTSPEPSPHRRL

SEQ ID NO: 14501 - protein, 474 aa, Trichodesmium erythraeum IMS101
MMVKTAQDVLNWIKSQDIQVIDLKFIDLPGIWQHLTVHQSQIDESSFTDGVAFDGSSIRGWKSINESDMMMVLDPTTAWIEPFMAEPTLSITCSIKEPRTGEWYSRCPRVIAQKAVDFLKTQGIGDTVYFGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAKRLEFRCPDATCNPYLAFAAMLCAGIDGILNEIDPGPSLDVDIYDLSPEELSKIPSTPGSLEGALEALEKDHEFLTAGGVFTEDLIQTWIDYKMENEVKPMRLRPHPYEFSMYYDC

SEQ ID NO: 14502 - protein, 391 aa, Triticum aestivum
  unsure (1)..(391): unsure at all Xaa locations
LTPSVPDPEARPHAIHPSLHTARLTPYRTGDRGLAPPSSSGERARGQAGIRRAAEEPEGFPAGEGGAGVLGGAPAPARGGGRRGERACGDGRSAAGDSWSLNNDYGSTLDDEQRYADTAEVLLASCPSSASSSAASAAAPSACSSSLPPQRPXSSDFSFDKDVPDVVPPMLGLHNYQDGAYAEEITMXRSHADDWFGTEAMDVLVGWTKNLCSSKDXLLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATVSEGALASDAVVFKYLDHVQAYPNVDGVCIATVAFLHT

SEQ ID NO: 14503 - protein, 364 aa, Buchnera aphidicola (Thelaxes suberi)
MTKKLYKIAVLPGDGIGPEIIQEAYKIIDVLQKKFSFNVKMHEYDIGGISIDKHGTALTQETIEGCENSDAILFGSVGGSKWDHLPEIEKPEKAGLLKLRKHFNLFANIRPCKLSQHLLDISPLKNSIIKKGIDLICIRELTGGIYFGKSNKITNIDDPYAFDTEIYFRSEIKRIAKIAFQIAQSRKKKIVSIDKANVLKSSILWRDTVNKMAYKFPNVKLEHMYIDNATMELIKNPSSFDVILCSNLFGDIISDECAAIIGSIGLLPSASLNKSGFGLYEPAGGSAPNIAGKTIANPIAQILSLSMLLKYSLHLPFLSSCIDEAVHEALVKKYMTMDISKNPQNFLKTNEIGDKISDLLAKKA

SEQ ID NO: 14504 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLL

SEQ ID NO: 14505 - protein, 381 aa, Eremothecium gossypii
MQASTYYVISNMPHTTADSSTQRVRVAVLGAAGGIGQPLSLLLKTQLAQVLGDANASLELALYDVAADALAGVAADLSHVNTPVEVSHHVPSSREDEEALREALTGASVVVIPAGVPRKPGMTRDDLININAGIIKTLAKGIAGACDLEKVFVLVISNPVNSLVPVMVRQLIRHAEAKQAPHAGVERRVFGVTQLDMVRASAFVRSLGELGNEVPSVPVIGGHSGETILPLFGPVQQRLQFSLEQRKKLTHRVQYGGDEIVAAKKGAGSATLSMAYAAYVVAERFTNLVLGNVSEIQETLYVSLYDRENKPIAEGAAELLSNIGETPYFAVPVKISADAGVVRVEHEVWQQLDDYDREHLLPACLEGLRKNIETGETLGSN

SEQ ID NO: 14506 - protein, 335 aa, Listeria monocytogenes EGD-e
MDTVILITVIIVIVGLAFDFINGFHDIANAVATSISTRALKPRVAIGIAAVMNFLGAISFTGVAESLTKSIVDPFSLNNGEFVVLCGLIAAVIWNLMTWLVGMPSSSSHALIGAIAGASIASASSFSVLNWSGFTTIIIALIISPIIGFTVGYLIYSLFKHLFHDKKLGKMNRRFRFIQIGTAAAQAYSHGTNDAQKTMGIITLALVASGLLKESAGIPFWVQVSCAASMAIGSSVGGYRIIKTVGTKIMKITPVTGVASDLSSLSVIMTATLIHLPVSTTQVIDSSIMGVGTANHKKEVNWRTGKNMVVTWFITLPLAGLLAAVVYWISAAIFL

SEQ ID NO: 14507 - protein, 480 aa, Streptomyces coelicolor A3(2)
MASAPAFDYAPAPESRAVVDIAPSYGVFIDGEFTEAADGKVFKTVSPATEEVLSEVAEAGEADVDRAVKAARKAFEKWSALPGAERAKYLFRIARIIQERSRELAVLETLDNGKPIRETRDADLPLVAAHFFYYAGWADKLDHAGYGADPRPLGVAGQVIPWNFPLLMLAWKIAPALATGNTVVLKPAETTPLSALFFADICRQAGLPKGVVNIITGDGRAGAALTAHPDVNKVAFTGSTAVGKQIARTVAGTRKKLTLELGGKGANIVFDDAPIDQAVEGIVNGIFFNQGQVCCAGSRLLVQESIHDELLDSLKRRLTTLRLGDPLDKNTDIGAINSAEQLARITALADQGEAEGAERWSPACELPSAGYWFAPTLFTNVTQAHTVARDEIFGPVLSVLTFRTPDEAVAKANNTPYGLSAGIWTEKGSRILAVANKLRAGVIWSNTFNKFDPTSPFGGYKESGFGREGGRHGLEAYLDV

SEQ ID NO: 14508 - protein, 161 aa, Zea mays
MDGRMFGLETPLMVALQHFLDVPDGDAGAGGDKAGGGGPTRTYVRDARAMAATPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 14509 - protein, 100 aa, Zea mays
MAAASGRAPSACALLLFLLLVVGAAAAAAVVVDAPAPSPVSFIDCGSACGARCALSSRWNLCPRACGSCCARCNCVPPGTAGNHDVCPCYAAITTRGGRP

SEQ ID NO: 14510 - protein, 118 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEV

SEQ ID NO: 14511 - protein, 246 aa, Triticum aestivum
MMDLHIKPDPQQEAHESAPSTKSFQHSPEATGTELERALHGRHLQFIAIGAAVGTGLFIGTGNALATAGPVSLLIAFIFVGTLLFSVMTALGEMAAYIPVAGAFTTYATRFLDPTFGFAMGWIYWFSWSITFALELTAAGLIIQYWEKDLSIGIWITVFWFLFTAANFMPVRWFGEFEMWFSSIKVITIIGFIIFSICVNAGVGDQGYIGFKYWKDPGAFNEHIVEGDIGRFVGFWSVLITAGFSY

SEQ ID NO: 14512 - protein, 197 aa, Triticum aestivum
MDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 14513 - protein, 332 aa, Saccharomyces cerevisiae
  unsure (1)..(332): unsure at all Xaa locations
MVRVAINGFGRXGRLVMRIALQRKNVEVVALNDPFISNDYSAYMFKYXSTHGRYAGEVSHDDKHIIVDGHKIATFQERDPANLPWASLNIDIAIXSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRXPTVDVSVVXLTVKLNKETTYDEIKKVVKAAAEGKLKGVLGYTEDAVVSSDFLGXSNSSIFDAAAGIQLSPKFVKLVSWYDNEYGYSTRVVDLVEHVAKA

SEQ ID NO: 14514 - protein, 291 aa, Brassica napus
MANHKNLFFLCFLIGLGLCSARRALLSSYEPEDEVAGYGEKSSLHAGYGIGVDAGVGVGGGGGEGGGAGYGGAEGIGGGGGGGHGGGAGGGGGGGPGGGSGYGGGSGEGGGAGYGGGGAGGHGGGGGSGGGGGGGAGGAHGGGYGGGEGAGAGGGYGGGGAGGHGGGGGGGNGGGGGGGGAHGGGYGGGEGAGAGGGYGGGGAGGHGGGGGGGKGGGGGGGSGAGGAHGGGYGAGGGAGEGYGGGGGEGGHGGGGGGGGGAGGGGGGGGGYAAAGSGHGGGAGRGEGGGGY

SEQ ID NO: 14515 - protein, 718 aa, Blumeria graminis f. sp. hordei
MRLSLWNLLGLSGLVVASCPYMSGEDQEYHISHIQARGTDSEFLDQFKVEDSNSYLTTDAGGPIQDDASLKAGERGPTLLEDFIFRQKIQHFDHERVPERAVHARGAGAYGTFTSYADWTNITAASFLNSKGKETPVFVRFSTVAGSRGSADTVRDVHGFATRFYTDEGNFDIVGNNIPVFFIQDAILFPDLVHAVKPSPDSEIPQAATGHDSAWDFFSQQPSTLHTLFWAMSGHGIPRSYRHMDGFGVHTMRLVTDDGKSKLVKWHWKTKQGKASLVWEEAQILAGKNPDFHRQDLWDDINAGNGPEWELGVQIVDEEDVQAFGFDLLDPTKFLPEELVPVTILGKMKLTDNPTNYFAETEQVMFQPGHIVRGVDFSDDPLLQGRIYSYLDTQLNRNGGPNFEQLPVNRPRTKVHNNNRDGAGQMFIHTNKAPYSPNSLSGGNPKQANQTKGRGFFTAPSRKVVGSLHRGTASSFADVWSQPRMFYNSLIPSEQQFLVNAIRFEISQLKSDLIKKNTLMQLNRVSNDLATRVAAVIGYKPLDPSPEFYTNATTDYVTIFGKPLPSVVGFTVGILASTSSSTSISQAAQLATSFSSRGIRAVIVGESLLSGTDQTYSSADATAFDAVVVTMGAETLFGPVAKPNTLFPSGRPSQILHDAYRWGKPVGAVSKASVVLEPLPGTKNQGGVYRVESVNELATSIAKGLETFRFVDRFPLDS

SEQ ID NO: 14516 - protein, 110 aa, Zea mays
MAKHHPDLIMCRKQPGIAIGRLCEKCDGKCVVCDSYVRPCTLVRVCDECNYGSFQGRCVICGGVGISDAYYCKECTQQEKDRDGCPKIVNLGSAKTDLFYERKKYGFKKR

SEQ ID NO: 14517 - protein, 208 aa, Clostridium perfringens str. 13
MKRPIFIGITGGTGSGKSTIAKEIYRQFGEDCIAMIEQDSYYKDQSHLSMEDRVKTNYDHPNAFDNNLLVSHLESLLNGHSIQKPSYDFSIHNRIEDTTKVEPKEIVIVEGILILEDPRIRELLDIKIYVDTDADVRIIRRMVRDINERGRTMESVINQYLNVVKPMHNQFTEPTKKFADIIIPEGGHNKVAIDIIVAKIKEVLGKYE

SEQ ID NO: 14518 - protein, 504 aa, Triticum aestivum
  unsure (1)..(504): unsure at all Xaa locations
LTSRSACVRVHGVQFRPSSSFDTKTTTTNAGQPVWNDNEALTVGPRGPILLEDYHLLEKIAHFARERIPERVVHARGASAKGFFECTHDVTGLTCADFLRAPGARTPVXIVRFXTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 14519 - protein, 621 aa, Dechloromonas sp. RCB
MSSHSKQALPAITVAAIGVVFGDIGTSPLYALKEIFNGHHPIPVTPENILGVLSLVFWAIIVLVTIKYVAIIMRADNRGEGGSLALLALVTERAKNPRLSWIITLLGIFAAALFYGDSMITPAISVLSAVEGLEIITPDLKSYVIPITLGILTGLFFIQKHGTGAVGKLFGPVMVAWFGILAILGLKEIAYNPAVLLALNPLFAIVFVAEHTGLAFLALGSVVLAVTGGEALYTDMGHFGRFPIRLAWFGFVMPALVLNYFGQGALLLIEPEAIASPFFHLAPDWALIPMVGLATAATVIASQAVISGAFSVARQSIQMGLLPRMQIIHTSGMEEGQIYVPFTNWSLYLAVIALVIGFKNSSNLAAAYGIAVTGTMLIDTILVAFVMVLMWKWNKLLVALVAGTLLLVDIAFFAANAIKIPEGGWFPLAMGLVSFTVLTTWRRGRRMVSEEMAKQSIPMSDFLQSIDDVHRIYGTAIFMTSAKDGVPPALLHNLKHNQVLHERVVLVTVQTTDTPTVNDMERIYLHRMQKGFMRLIVRYGFMESPDIPGALELCKGHGERFDMMETTFYLSRETIVPSMARGMLPWRARLFAVMSKNATSASDFFHIPTNRVVELGTQLVI

SEQ ID NO: 14520 - protein, 204 aa, Xylella fastidiosa Ann-1
MHLISNDFKNGQPIPVECAAGQTDGFAPNRNPHLAWDDVPENTRSFALLCIDPDVPSIPETIGRTDMEIPVTQPRIDFVHWVMSDISTDLRMIAHGSCSDGFVVGGKTMPPGPAGTHQGLNDYTKFFANTPEMAGDYYGYDGPYPPFNDLRIHRYLFRLFALDLEHLPLPKRFDGPTLLRTIQGHVLTEATLYGTYTLNPKAQK

SEQ ID NO: 14521 - protein, 146 aa, Glycine max
MDFSSVRAALDSKSYDKVADVCDNLMLQVAAEGIAYQDDWPYTIHLLSHIYVHDINSARFLWKSIPSSIKESQPEVTAVWKIGQKLWLRDYAGVHEAIRGFDWTQELQTLVAAFSELYTKEFFQLLLAAISAISIKDTALFLGMNE

SEQ ID NO: 14522 - protein, 118 aa, Triticum aestivum
  unsure (1)..(118): unsure at all Xaa locations
MAPAVTXSSXTTVAPXQGLKSTAGLPVSRRTSXQPRQXHNGGRXRCMQVWPXEGIKKYETLXYLPPLATEALLKQVDYXXRSXWVPCLEXARWLRFRXHNSPPGXXXGRXWTMXKHGA

SEQ ID NO: 14523 - protein, 201 aa, Triticum aestivum
HSPPLLAAPTTVSSSPLPSLPSAPPPPRARFLRVSGRGMADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGAYAQGMGYMQPQYHNGDT

SEQ ID NO: 14524 - protein, 106 aa, Zea mays
  unsure (1)..(106): unsure at all Xaa locations
MTSTMAGVGKEDNKTAEGGAHINLKDEGQDDNEVILRIXRRPPTLIEGDXTAYCDRQSVDMNAIGFLXDGQTASPLMRHPDELHMEDGYXIDAMLHQTVSMGPSTT

SEQ ID NO: 14525 - protein, 359 aa, Zea mays
DHEIHDRMKDMFWSPDKFVRAPGGSSSNVALALAAIGGRVAFMGKLGDDDYGQSLLYHLNINGVQTRAVYMDPSAPTAVSLMKVRTEGSLKTNCVKPCAEDRFLPSDINPAVLKEAKMFYYNSSALLEPTTESSLLKAIDVSKKFGGTIFFDLNLPLPLWSSSKETKSLIKEAWEAANIIEVTKQELEFLCGIKPSEKFDTNDNDKSKFTHYSSEVIMKLWHSNLKVLFVTNGTSKIHYYTETHNGWVRGTEDAPITPFTGDMSQSGDAIVAALMRMLVINPHLITDKVYLHKAVKHAIKCGVIDQWVLARERGFLPKERADPTGEQYEVRSITEREYRTLPDAMQSENSSTSELAYVE

SEQ ID NO: 14526 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 14527 - protein, 510 aa, Xerophyta viscosa
MFIESFRVESPHVRYGAAEIESDYQYDTTELVHESHDGASRWVVRPKSVRYNFRTTTTVPKLGVMLVGWGGNNGSTLTAGVIANREGISWATKDKVQQANYYGSLTQASTIRVGSYNGEEIYAPFKSLLPMVNPDDLVFGGWDISNMNLADAMTRAKVLDIDLQKQLRPYMESMVPLPGIYDPDFIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 14528 - protein, 170 aa, Helicobacter pylori
GSGMHTHVSVWKNNENLFSGETYKGLSGLALHFLGGVLHHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 14529 - protein, 378 aa, Weissella paramesenteroides
MNRVLKVHKSHTGVLDIKADISIKTPDDLSEAYTPGVSGIAKMIAEDEALKNVYTMSGKLIPIITDGSAVLGLGNIGPAAGLPIVEGKALIYKEFSGVNAIPMALNQVDVDEFVETIKTMAPSFAGIHLEDIAAPRVFEIEKRLNEELDIPVYHDDQTGTAVVVLAALINAAKVVNKPLKDLKVVINGMGAAGVATAKILLASGMKNLTLVDIHGVIRADDNDYNEYQRELATAVNQVDGRSLDDVIDNQDVFIGLSDANVLSKEQVTRMAQDAIVFALANPVPEILPEEAHEGGATITATGSSQWANQVNNVLVFPGLFKGLLATDIKKVELSLQVKLAEGLAQMVTTPTADHIVPRVFDDGVVDAVSNAVIAYAKA

SEQ ID NO: 14530 - protein, 170 aa, Zea mays; identical to SEQ ID NO: 2818

SEQ ID NO: 14531 - protein, 324 aa, ASPERGILLUS NIDULANS FGSC A4
MGVGLGGDYSLSAVICSEFAPTRIRGWMPAAVFCCQSLGSLAANMVALIAVAGFHHRLLEDDSGAGCTGRCVQDVDRIWRLIVGLGAVPEFIALWFRLTTIGSPRYTAEVTQNSLQAAADVSYFFRPDEAIPAPEMGQITATIVISPATTEPVLYPSSVNSTRSSVSEVTPTVDSMVVVSSGAVVGNLIAIFTIDRLGRRNIQLNGFFWLYILNIVVGTSFCHPEQRTDSSALVVYISLCQIFNFGPNTTTYILPAELFATRLRCTCHGLAAAAGKLGSVIAHIFISFVDYGSAHTIKMILGTCWGFLFFAHGLLRLQAVYNAC

SEQ ID NO: 14532 - protein, 397 aa, Clostridium tetani E88
MLSKKGKEISPSVTLAITAKANEMKKDGIDVVGFGAGEPDFNTPENIQNAAIKAMREGYTKYTPVSGVVELKDAIVNKFKKENNLIYKSSQIIVSTGAKQCIANLFMAILNPGDEVLISAPYWVSYPELVKLADGVPVFVDCKKENDYKYSIDELEKRVSSKTKAIIISSPNNPTGSIYYEEELRDIAEFCKKHNLIILSDEIYEKLIYGHNKHISIASLNEDTYNRTVVINGVSKTYAMTGWRIGYAAGPGNVIKLMNNIQSHMTSNPNSIAQYAALEALTGEQESINSMVSEFEKRRNYMVERINSINGIECIEPKGAFYMFADINKVIGKKINGEEIKNSVDFCEKLLELYKVAVVPGAAFGLENHIRLSYAISMENIEKGLDRISNCVSELQS

SEQ ID NO: 14533 - protein, 267 aa, Mycobacterium leprae
MMRVKARMNNECSRLIIDCHITSMARFTVMDDRRVADIKRGQAARNAKLASIPVGLAGRAVLGLGKRLTGKSKDEVNTKLIEKTAHQLFSVLGELKGGAMKVGQALSVMEAAIPEEYGEPYREALTKLQKDAPPLPVNKVHRVLDAQLGTKWRDRFSSFNDTPVASASIGQVHKAVWSYGREVAVKIQYPGADEALRADLKTMQRMVGILKQLSPGADIQGVVDELVERTEMELDYRLEADNQRAFARRIRATRALWCQTWWQAHRK

SEQ ID NO: 14534 - protein, 365 aa, Fragaria x ananassa
MGSTGETQMTPTHVSDEEANLFAMQLASASVLPMVLKAAIELDLLEIMAKAGPGSFLSPSDLASQLPTKNPEAPVMLDRMLRLLASYSILTCSLRTLPDGKVERLYCLGPVCKFLTKNEDGVSIAALCLMNQDKVLVESWYHLKDAVLDGGIPFNKAYGMTAFDYHGTDPRFNKVFNKGMADHSTITMKKILETYKGFEGLKSIVDVGGGTGAVVNMIVSKYPSIKGINFDLPHVIEDAPQYPGVQHVGGDMFVSVPKGNAIFMKWICHDWSDEHCIKFLKNCYAALPDDGKVILAECILPVAPDTSLATKGVVHMDVIMLAHNPGGKERTEQEFEALAKGSGFQGIRVCCDAFNTYVIEFLKKI

SEQ ID NO: 14535 - protein, 66 aa, Oryza sativa
  unsure (1)..(66): unsure at all Xaa locations
YCQNVWHXARVRKYLSPEDWSPTETKGRPWYGLLALLRKYPEHFVINTRSKGRVTSEFVSLVSLLS

SEQ ID NO: 14536 - protein, 101 aa, Triticum aestivum; identical to SEQ ID NO: 7108

SEQ ID NO: 14537 - protein, 568 aa, Oxalobacter formigenes
MSNDDNVELTDGFHVLIDALKMNDIDTMYGVVGIPITNLARMWQDDGQRFYSFRHEQHAGYAASIAGYIEGKPGVCLTVSAPGFLNGVTSLAHATTNCFPMILLSGSSEREIVDLQQGDYEEMDQMNVARPHCKASFRINSIKDIPIGIARAVRTAVSGRPGGVYVDLPAKLFGQTISVEEANKLLFKPIDPAPAQIPAEDAIARAADLIKNAKRPVIMLGKGAAYAQCDDEIRALVEETGIPFLPMGMAKGLLPDNHPQSAAATRAFALAQCDVCVLIGARLNWLMQHGKGKTWGDELKKYVQIDIQANEMDSNQPIAAPVVGDIKSAVSLLRKALKGAPKADAEWTGALKAKVDGNKAKLAGKMTAETPSGMMNYSNSLGVVRDFMLANPDISLVNEGANALDNTRMIVDMLKPRKRLDSGTWGVMGIGMGYCVAAAAVTGKPVIAVEGDSAFGFSGMELETICRYNLPVTVIIMNNGGIYKGNEADPQPGVISCTRLTRGRYDMMMEAFGGKGYVANTPAELKAALEEAVASGKPCLINAMIDPDAGVESGRIKSLNVVSKVGKK

SEQ ID NO: 14538 - protein, 490 aa, Yersinia pestis CO92
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPQALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELGSFNSVF

SEQ ID NO: 14539 - protein, 425 aa, Brassica napus
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 14540 - protein, 253 aa, Pantoea cedenensis
  unsure (1)..(253): unsure at all Xaa locations
GAAGGIGQALALLLKTQLPAGSDLSLYDIAPVTPGVAVDLSHIPTAVNIKGFCGEDATPALKGADVVLISAGVARKPGMDRSDLFNVNAGIVRNLIEQVANTCPKALIGVITNPVNTTVAIAAEVLKKAGVYDKNRLFGVTTLDIIRSNTFVAELKGKNPAELNVPVVGGHSGVTILPLLSQVPGVSFSQQEVVDLTKRIQNAGTEVVEAKAGGGXATLSMGQAAAKFGLSLVRAINGESNVVECAYVEGDGQ

SEQ ID NO: 14541 - protein, 471 aa, Thermosynechococcus elongatus BP-1
MATPQEILNLIDSKYELIDLKFTDMPGTWQHLTVHKSQISESSFTEGVPFDGSSIRGWKAINESDMVMVPDPNTAWEDPFMKEPTLSLICTIKDPRTGELYDRCPRSIATRAIEYLKATGIGDTAYFGPEAEFFVFDDVRYDQNQKSGYYYIDSIEGVWNSGREEEGGNLGYKIRGKEGYFPVAPTDTLQDLRTEMLLTMAKCGVPIEKHHHEVATAGQCELGFRFGTLVQAADWLMTYKYCVKNVARKHGKVATFMPKPVFNDNGSGMHTHQSIWKDGQPLFWGDGYANLSQIALWYIGGILKHAPALLAFTNPTTNSYKRLVPGFEAPVNLAYSQGNRSASVRIPLTGPNPKAKRLEFRCPDATSNPYLAFAAMLCAGIDGIKNQIDPGSPLDVDIYDLSPEELAKIPSTPGSLMAALENLQKDHSFLTAGGVFSEDFILNWIQYKLDTEVIPMSLRPHPYEFALYFDA

SEQ ID NO: 14542 - protein, 314 aa, Arabidopsis thaliana
MASILKTTKVPILDLTSQQELKPNTSTWRSVSREACEALEEYGCFLAVYDGVTQQLDDSIFAAAEELFDLPTETKKKNVNEKPYHGYVGQMPVIPLHEGLGVDYVTNKEIAQRFTHLMWPQGNDRFCNTVHTFSNAVAELDRLVVRMIFENYGVEKHYESHVGSKTYLLKFLKYLAPPESISMPAFPQHTDKTFLSILHQNDVNGLEVKSKDGEWISLQLPPKSYVVMAGDISMGWSNDRIRSCEHRVTMEGDKTRYTLGLFSFLTDLVSIPEELVDDKHPLMYKPFDNIALINFYTTKEGREANSTLKAYCGI

SEQ ID NO: 14543 - protein, 268 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQMKSRMMGDSAYKSTFDCFIKTLKNDGPLAFYKGFIPNFGRLGSWNVIMFLTLEQVKKFFIKEVPN

SEQ ID NO: 14544 - protein, 437 aa, Haemophilus influenzae
MEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 14545 - protein, 278 aa, Flavocetraria cucullata
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 14546 - protein, 357 aa, Populus balsamifera subsp. trichocarpa
MGSLETERKIVGWAATDSTGHLAPYTYSLRDTGPEDVFIKVISCGVCHTDIHQIKNDLGMSHYPMVPGHEVVGEVVEVGSDVTKFKVGDVVGVGVIVGSCKNCHPCKSEIEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGLASMIEVIKMDYINTAFERLEKNDVRYRFVVDVAGSKLIP

SEQ ID NO: 14547 - protein, 306 aa, Clostridium tetani E88
MMQSKIESIIEECRKYTREGEVASYIPELKKADKDALGIYIDKLDGNEFCAGDYDTKFTIQSISKIIALIIAIMDNGMEKVLSKVGVEPSAYSFNSIVTLEVKNANKPLNPMINAGAIATVSLIKGNSPEEIIERILEFTRKVTGNKNIKVNEEVYQSEKKTGDRNRSLAYFMKGTGIIEKDVEKVLDAYFQQCSIEVTCKDIAKIASFLANDGVLPSTGERIIPAEVAKIVKAVMVTCGMYDASGSFAVKVGIPSKSGVGGGILATVPGVMGIGVFGPALDKKGNSIAGVKILERLSEELNLSIF

SEQ ID NO: 14548 - protein, 1086 aa, Oryza sativa
  unsure (1)..(1086): unsure at all Xaa locations
MASTNESYFDCREYRRKAVFFLRCYALSTSCKLFRWKTKVAEQRGASAAEQLAWSASGGGQVRLRSGAEGQRRRFRAILRATSGRRKRAPDVKSFSHELNIRGPLLHPLQQRKPRGCVNSPEEFIGAIRTKFIRLKEEVDAELGVFAGDLVGALDKADGDEERVALEDLLVVAQRCAEMSPEELWVKCECIVQGLDDRRQELTAGVLKQAHTRVLFILTRCTRLLQFRKEGGGYVAADDKQHVLSLHQLSDLGLYPFKVAGGSSELGRKSTSSLTELKERLIRRRMLEHKQLTLDFSAGRVISSDTGGDSPGSGGKISSWKKLPSPAEKTLHKVTEPTTEEKTTPTKKKAITRNKVAVDEIVERIDAASIHPDGLSYLGDSAVKLEVPSGFPEAQQIIVDGKPRMICRICDFEIPMVCAEGHFIVCTLADRCDSKGLNTDQRLQRVAEVLGRVLGCFESKSPQTAECNHNETARGSTSSLTESDGSMDHDILSHLLTVPSTELFSEVVASSSSNNSILRRGALTPASGSMPQSPLLTPRTSHAESQLTKHKAFVELENFQQVESLMTIARGIERIKNSEYNSLEDLSSYLEDLNAVIDTRKVDALVVETFGRRIAKLLQEKFIQLCGQIEDSNTDSLGSIDEDGPMESSVSSRTSQMNGKFKDRTSIEDFEIIKPISRGAFGRVFLAKKRVTGDLFAIKVLKKADMIRKNAVESILAERDILISARNPFVVRFFYSFTCRENLYLVMEYLNGGDLYSLLRNLGCLDEDMARTYMAELVLALEYLHSMNVIHRDLKPDNLLISRDGHIKLTDFGLSKVGLINSTDDLSGPDVSNVLVGDHQPADAEQRAQKREQRQKQAAVGTPDYLAPEILLGMTHGPTADWWSVGVILFELLVGIPPFNAEHPQIIFDNIMNREIPWPQVPEELSFEAYDLIDKCYFNSVNFHVRLLIENPVQRLGATGAGEVKAHPFFKDINWDMIARQQAAFIPSTDDEYDTSYFACRHTWDDQVNVASNDYDDRSETSSMSSFSKKHXQADEFGSMEEFGAPSLSVKYSFSNFSFKNISQLASMNYDLITKHNEDPLQSSKS

SEQ ID NO: 14549 - protein, 545 aa, Neurospora crassa
MSPRAFALAHQRDRGSFVGCSRIADYEVLGKLGEGTFGEVHRARSRKTGALVALKKIIMHNERDGFPITALREIKLLKLLSHKNVLRLEEMAIEHPPRTDKRTRPIVYMVTPYMDHDLSGLLDNPSVRFTEPQVKCYLLQLLEGLKYLHANHILHRDMKAANLLINNKGVLQIADFGLARHYEGDIPQPGKGSGEGKRDYTSLVVTRWYRPPELLMHLKRYTTAIDMWGVGCVFAEMLEGKPVLQGESDLHQLELVWDLCGTPSEETMPGWRTLPGGQAFSSKPRPGNLARRFEKHGPVVISLLKELFKLDWRSRINAIDALNHPYFRTAPLPALPGDLPTFEESHEFDRRKFQDRKAALPPAPKGGTVGRGAVVNSQGPDTGFSGRDGYGGGGRNGANGGRYPPYHRGPPPGDERVPSWHSARGLPPRPPMPADYHGSGPMDHTDGYRDRPPRRGPGGPPGGGGGPSNVDTYIPSYDRDGPAPRREDWRRRDDWDDRRGGVDRDRRRPEYDVRSRDSRTRSRTRSRSPVRDRDRGRDRDAYARR

SEQ ID NO: 14550 - protein, 456 aa, Escherichia coli
MMEGQQHGEQLKRGLKNRHIQLIALGGSIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFLLLYPLGNWICLLFMAAVLVIMLMTRGMGIWVYLIPVWLIVLGIGYLFKEKTAKAVKAH

SEQ ID NO: 14551 - protein, 180 aa, Zea mays
TIIGNKNYYDIRKPCIGSLCYDFSNLEKFLNLKSVRESLGVGDIEFVSCSPTVYEAMLLDWMRNLEVGIPELLESDIKVLIYAGEYDLICNWLGNSRWVNSMEWSGKEAFVSSSEKPFTVDGKEAGVLKSHGPLSFLKVHDAGHMVPMDQPKAALEMLKRWTSGNLSEPSSSSQRLDFTM

SEQ ID NO: 14552 - protein, 262 aa, Zea mays
RGRVQTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPVYSLGSLVAFQAMVSIATIGLYISYALPILFRVTLARKYFVPGPFNLGRYGVLVGWVAVLWVATITVLFSLPVTYPVTKDTLPAAPVAVGGLLFLVLASWLLSARHWFKGPVTNLDG

SEQ ID NO: 14553 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 14554 - protein, 433 aa, Ferroplasma acidarmanus
MFDFIDYLSISNILINNLWIVIAAIFIFAMTIAVGFLEVGELGKKFKNSMLKTIVITGTAMFVMAIIGFNTAFAPTLYGIIGNPFYKDGFMLGGFSPGVIFNTWWSMGTSYFNTGLTTGSYFFFETACAAVTLALVGVIVLNKVKFGAFFAFSIVYFIFIWNLPAAWIWNPSGWLYQMGMRDFAGGIVVHGAAAIAGLAIVYEIWREERKKGLKTSLKVNIKPDYQWLAVGILILWIGWFGFNPGSILAFNDDVLVVVIATFVASGAGMVSTMLFSRMFDRETPIIIVAVNGILMGLIIVTPLAGFVSPASALILGLIGGPLFVGAEKLFAKVKWFSDPVGLFPAHGVGGIFGVLMIGLFTQHAFAAASGNAILPNGLLFGGGFAALRQLGIEAFGVFVVVITVFAISFLAIFIIGKISHGILNEDAYKQSER

SEQ ID NO: 14555 - protein, 511 aa, Triticum aestivum
  unsure (1)..(511): unsure at all Xaa locations
MFIESFRVESPNVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKXAPLVPPGTPVVNALAKQRAMLENIMRACVGLAPENNMILEYK

SEQ ID NO: 14556 - protein, 546 aa, Enterococcus faecium
MLTGLNLLNNPFLNKGTAFTKEERAKYGITGMLPSTVQTLEQQSVQAYGQYLSKQTDLEKRIFLMNLFNTNRTLFYKLMGEHLVEFMPVVYDPVVADSIEQYNEIFLKPQDAAFLSIDEPENIKASLKNAADGRDIRLIVVTDAEGILGMGDWGVNGVDIAIGKLMVYTAAAGINPAQVLPVSIDAGTNNEELLNNPLYLGNRHARVEGETYYEFIDQFVQSATELFPELLLHWEDFGRGNAAAILEKYEDQITTFNDDIQGTGIVVLAGVLGGLNISGEQLKDQIILTFGAGTAGVGIANILLDEMIRQGVPEEEARQHFYQVDKQGLLFEDTEGLTPGQIPFARKRSDFTNADELTNLEAVVKAIHPTIMIGTSTQPGAFTEEIVKEMAAHTPRPIIMPLSNPTKLAEAKAKDLIEWTDGKALVGTGIPAADVEYNGVTYQIGQANNALMYPGLGLGLIASTATRVNAEIISQASRALGGIVDVTKPGAAILPPVAKITEFSQTIAETVAKSVVAQNLNREEITDIKEAVESAKWVPEYKSLED

SEQ ID NO: 14557 - protein, 453 aa, Ahnfeltiopsis concinna
  unsure (1)..(453): unsure at all Xaa locations
KETVVLALFRVSPQPGVDPVXASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAASGETKGHYLNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 14558 - protein, 411 aa, Photobacterium profundum
MGCCDAPGLMPVETALDKILADVKPLSSVMTVALSDAMGRVLAEDILSPINVPPFANSAMDGYALRADDLKDSDTLVLSGKSFAGAPFEGVCEAGQCIRIMTGAQMPEGTDVVIMQEETEVEGDNVRFLIKPKAHDNVRPIGDDIHQGDTVIAKGTRITAREMPLLASLGIAEFTVFARPVAAFFSTGDELRPVGEPLAAGQIYDSNRYGIRALLEKFGCDVLDLGIIPDNPEKLRAAFKKATTEADVLVTSGGVSVGEADYTKDILEEQGEIGFWKIAMKPGKPFAFGTIDNTWFCGLPGNPVSAMLTLYQLVQPMLAQLSGHSQYQPPQRITAKATTLFKKRPGRTDFQRGIYQINPQGQLEVATTGNQGSGAFSSMHQANCFVVLEQERGRVSPGEDVTIELFNHSMY

SEQ ID NO: 14559 - protein, 148 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVVECACVIELPELKGRERLGDKSLFVLINGGA

SEQ ID NO: 14560 - protein, 225 aa, Lithachne humilis
IENKISRQVTFAKRRNGLLKKAYELSLLCDAEVALVIFSGRGRLFEFSSSSCVHKTLERYRSCNYNTQEANAPVENEINYHEYLKLKTRVDFLQTNQRNILGEDLGPLSMKELEQLDNQIETSLKQIRSRKNQVLLDQLFDLKSKEQELQDINKDLRKKLQETNGDQKVVHINSWQDGGQGSSSGHAIEPYQGLIQHPENDPSMQIAYHQVYMDQLNHEDMAAQH

SEQ ID NO: 14561 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARM

SEQ ID NO: 14562 - protein, 561 aa, Oryza sativa
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQASNFPIILSLQAYSIISFHIISYGVKQKIRTGNLLAELVPLGEYVQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSVDRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 14563 - protein, 468 aa, Pseudomonas aeruginosa PAO1
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 14564 - protein, 322 aa, Phyllostachys edulis
MASTLSFPVIDMGLLGGDERPAAMELLRDACENWGFFEILNHGISKELMDEVEKMTKGHYKMVREQRFLEFASKTLKDGCDAQGVKAENLDWESTFFVRHLPESNITEIPDLDDDYRRVMKRFAAELEKLAEGLLDLLCENLGLEKGYLARAFRGSKGAPTFGTKVSSYPPCPRPDLVKGLRAHTDAGGIILLFQDDHVSGLQLLKDGEWVDVPPMRHSIVVNLGDQLEVITNGRYKSVLHRVVAQTDGNRMSIASFYNPGSDAVIFPAPALVEEEAGGTYPKFVFEDYMNLYVRHKFEDKEPRFEAFKSMERESSKRIAIA

SEQ ID NO: 14565 - protein, 228 aa, Buchnera aphidicola str. Bp (Baizongia pistaciae)
MKKFLLSSSVLSANFSRLGEDIFDVLKSGSDMIHYDVMDNHYVKNLTFGPIVLESLRSVEKIKSMVIDVHLMTCPVDDLIIKFAKLDVNIISFHPESTNNVEKTIKLIKSYGCKVGLALNPLTPLCVLDNVLDKIDLILLMSVNPGFPGQKFIPSILNKIRIVRELIDKSKKNILLEVDGGINLSNIFKIASFGTDIFVIGSAIFNSINYDLTIRSFRDVLKNINCKK

SEQ ID NO: 14566 - protein, 937 aa, Oryza sativa
MATASAPLQLATASRPLPVGVGCGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 14567 - protein, 309 aa, SYNECHOCOCCUS SP. WH 8102
MAPLRLWLLMVLPFALWGTAMTAMAPLIVSGGPWFVAAFRLLPAGFVLMAWAAISGRRWSLDGRDLPWFLLFTLVDACLFQGLLACGLAETGAGLGSVLIDSQPLLVALLARVLFAESINPIGWLGLALGLAGIVCLGVPADLLGHWWLLLDPPQLLQLLQPGEGWMLLAALAMAVGTVLIRYAARHSDPVAVTAWHMLLGGCPLLLAAEWQNGWTLPPWSVADWGRMGFATFLGSALAYGLFFWFANRRDLTTFSSLGFLTPVFALATGGWLLGERLDPLQWVGALMVLVSVVCVSQRRRLWEPQPVG

SEQ ID NO: 14568 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 14569 - protein, 595 aa, Ferroplasma acidarmanus
MYVEINFIFIKKITKFIILTKVLNKLPVSIAMQDVDNKVLGKRTKTGMRRGMSTHEAIMFGVGGAVGSGILFAAAGGTGYAGPAIIVSWIIAAIFIILVTLPFAEYAAMFPRSGISARVAYYSYGSYGGFMSGWGLLIWAATIPAIEAVAVSTYASLYFPFLYDSTTGVLTGYGILLAILLLLGFFALNMVGIARFGKFNKVLTWVKIGVVVAFIVILPLFIWHWGNFTSGLVGASSAGGFAGFMPSVGGLFIAIPASGILFSFGGYRQVADMAGEVKNPGKTMPKIIGTVLAVQSLLYIAMAVVIVGTVSWAGFGIQTGDWSFVAALGSPLSSIIHANIIPGMTVAEADLLGGMVIVFFLFAIFSPGGTLGVYLTGASRIIFGYSEEDALPKGFRKTTKHGAPYFALILALVLAIIFLLPLPSWYALVDFVVVAAVANFAVASISLPVLRRLYPNVERPFKIPHPMAWAFVSFEVATFLIYWATFPTTLYALGAVLAGSVVFIYQASRKHFMGLNLRNSVWIPVYIAGMIILSYVGGTPTGGLNIIAYPFDYVVLAIYAAIFFVIGLMSAPKEALISADSLLDTTKEVDVEGEY

SEQ ID NO: 14570 - protein, 497 aa, Vibrio vulnificus CMCP6
MGLASISVHAQTLTRDNGAPVGDNQNSITAGENGSVLLQDVHLIQKLQRFARERIPERVVHARGTGAHGEFVVSGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINRKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 14571 - protein, 485 aa, Magnetospirillum magnetotacticum
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 14572 - protein, 674 aa, Schizosaccharomyces pombe
MIPSANSRFAFIIQRNYIPVVNSQNTRWKRLCGTQSVWSPYKKKHVLVNRLKHISLFPKPIFARKFTTRQKSEDQKQWRILRITFLVLPFTVGGLWILYRVKNRKNNIFSFDELELEERSNRPRSIFGKIKQFFNILLRSFNLFIIFSPIIITLPFIALISFLHLRSLSSLTVSIWLRFLVTQLERAGATFIKLGQWAASRTDLFPPAFCKTLSKLHSHVTPHSLAYTQSVICKTYKVESIEEIFVNFNPIPIGVGAIAQVYTATIKKAATQQDNSYFTSMLQSIGFRQKNISDAPVTQDVAIKVLHPNVEKYISLDLQILGFFAKLINLVPSMKWLSLPDEVKVFGAMLNQQLNLHYEALHLNQFRLNFRGNRYVEFPAPYDDYTTNQILLEDYMPGIPLSAFLKHKSGPFNKLLANTGNNALFQMLIVDNFTHADLHPGNVLVKFYKGIPKTIFNQDNEINDSIYKILSTCSTEEWDSAMEELNILGYRPTLVFLDAGLVTKLSTQDQKNFLDLFQAVLTFHGYEAGLLMVERSRQTERVINKDIFALKMEHLLNEIQKSTLSLKSLQIGTILQEVMTMAREHHVRIEANFANTVLSILLVEGAGRQLYPEMDLLSNATPYLRSASSKSNVSLTNPMVQLWIALEARQFLLLSTSKETVEKWVKSDMIAPNI

SEQ ID NO: 14573 - protein, 147 aa, Zea mays
  unsure (1)..(147): unsure at all Xaa locations
ASGGKGGFSSQRHHGKSQSHVAFENTSTNVAASQMRNALNRRADTVTDPAEGRYFETEMDNFFALFRRYLNDKAKGTAIDWNRIAPPKADQVVSYDDLANTEAVXYFFFLAVVNLNGGLGTSMGCLGPKSVIQVPQRMSFLDLSMRQ

SEQ ID NO: 14574 - protein, 655 aa, Cytophaga hutchinsonii
MSTIADSKNHGHQKLTAAGLLISLGIIYGDIGTSPLYVMKAIAGGNVISENLILGGLSCVFWTITLQTTIKYVIITLRADNKGEGGIFSLFALIRRRNPNLVWPAMIGGAAMLADGIITPPISVSSAVEGLLIFNKDIPTIPIVLAIIVMLFMIQRFGTNIVGKFFGPIMFIWFAMLATLGLSQLMGNFYVLKAINPMYAFNLLTQYTTVDDKSGFWLLGAVFLCTTGAEALYSDLGHCGRPNIRISWIFVKLALLINYFGQGAWILQNKGYVIKGNPFFGIMPEWFIVYGIIIATMAAIIASQAMISGSYTLISEALRLNLWPKVRVKYPSVKKGQLFIPSINLLLLAGCIFVVLWFGESSAMEGAYGLAINITFLMTTILLAYYLLIIKRISFIWVGLLILMYLIIEVSFLVANLEKFFHGGYFTLISSGILAFIMIIWYTAHRIKRRLTEYVKIQDYFPLIKELSEDTSIPKYSTHLIYLTGADNYTQIESKVIYSIFQKQPKRADIYWFLHIDVVDEPYTMEYKVRTMLADDVIRIDFKLGFRVEHRINLFFRKVVEDMVNNKEVDFTSRYTSLNKRNVIGDFRFVVLEKHLSNDNDLSVMEQFAMDWYFFLKHISISESSAFGLDTSSVTVEKVPMVISPMEAFQLKRVY

SEQ ID NO: 14575 - protein, 185 aa, Methanosarcina mazei Goe1
MESTITIENVVASTRLAEDFDLEKMMESGLEGAEYNKVKFPGLVYRINNPKAAFLIFTSGKVVCTGSKSIGNAHAAIINLANTLKSICCEKIDLEPDVRVQNIVASADLKTNLNLNTIAIAFGLENVEYEPEVFPGLIYRVEAPKVVVLVFSSGKLVITGGKCPEDCEEGLRIVKTEFDNLGLLY

SEQ ID NO: 14576 - protein, 275 aa, Xylella fastidiosa Temecula1
MIPISFEFYPPKNDDQRAQLDRTANRLRAFAPEYVSCTFGAGGSTLSYTSETVRHLSQHHGFDAAPHLSCVGGSRQEIRELLKLYRAIGCQRIVALRGDLPSGMGHPGDLRYAADLITFIRAEHGDHFHLEIGAYPETHPQASNTLNDLHYFKAKVDAGADAAITQYFYNPDAYFHFVDAVQRLGVTIPIVAGVMPISNFDQLRHFSEQCGAEIPRWITKKMQAYGDDTKSIRAFGADVVTALCERLIAGGAPGLHFYTLNLAKPSTQVLQRLGY

SEQ ID NO: 14577 - protein, 204 aa, Triticum aestivum
AELNLDLIRRARIFHYGSISLITEPCRSAHVAATRAAKSAGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 14578 - protein, 422 aa, Cyanidium caldarium
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 14579 - protein, 402 aa, Arabidopsis thaliana
MIIQQLHDQRVVLINLDSFYHNLTEEELARVHEYNFDHPDAFDTEHLLSCMEKLRQGQAVDIPKYDFKTYRSSVFRRVNPTDVIILEGILLFHDPRVRKLMNMKIFVCTDADVRLARRIKRDTVENGRDIGTVLDQYSKFVKPAFDDFILPTKKYADIIIPRGGDNHVAIDLIVQHICTKLGQHDLCKIYPNLYVIHSTFQIRGMHTLIRDSQTTKHDFVFYSDRLIRLVVEHGLGHLPFTEKQVITPTGCVYSGVDFCKRLCGVSVIRSGESMENALRACCKGIKIGKILIHREGDNGQQLVYEKLPNDISERHVLLLDPILGTGNSAVEAINLLISKGVPEGNIIFLNLISAPQGVHVVCKKFPRIKIVTSEIDNGLNEEFRVIPGMGEFGDRYFGTDDD

SEQ ID NO: 14580 - protein, 207 aa, Rhodospirillum rubrum
MTQKREVLAMSETKLDALRRHTIIVADSGDIDAIRSFAPQDCTTNPSLILKAAKMPAYAGLIAQAIEAGSAEAGPSEGLIDRILDHLAVTFGSELARIVPGVVSTEVDARLSFDTQATVARAERLIGLYAARGVAAERILIKVAATWEGIRAVEILQSRGIACNVTLVFSLAQAVAAAEAGAFLISPFVGRILDWHVKASGKSFDID

SEQ ID NO: 14581 - protein, 198 aa, Sulfolobus shibatae
ISNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIMGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 14582 - protein, 638 aa, Zea mays
MATAAAASTALTGATTAAPKARRRAHLLATRRALAAPIRCSAASPAMPMAPPATPLRPWGPTDPRKGADILVESLERCGVRDVFAYPGGASMEIHQALTRSPVIANHLFRHEQGEAFAASGYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVTIAKGFNIPAVRVTKKNEVRAAIKKMLETPGPYLLDIIVPHQEHVLPMIPSGGAFKDMILDGDGRTVY

SEQ ID NO: 14583 - protein, 637 aa, Rickettsia rickettsii
MNNQGRSILAWAVLFIFVILLFNVFQSDGLLGGRNNITFSDFLTRVDEKTVNSVKIQGRVIEGTSNDGSTFNTYAPDYPDLVNRLTSNDVNIEVVPLETRMNTFLGFLISWFPMLLLIGVWVFFMRQMHGGGKAMGFGKSKARLLSDKGPKITFKDVAGIDEAKEELTEIVDFLRDPSKFQKLGGKIPKGCLLIGPPGTGKTLLAKAIAGEANVPFFSISGSDFVEMFVGVGASRVRDMFEQGKRNAPCIIFIDEIDAVGRHRGIGMGGGNDEREQTLNQMLVEMDGFEANEGVVIIAATNRPDVLDRALLRPGRFDRQIAVANPDINGREQILKVHLKKIKYNSTVLARIIARGTPGFSGAELANLVNEAALIAARLGKKEVDMQDMEEAKDKVLMGVARRSIAMSEKEKRLTAYHEGGHALVGLYCPAASPIHKATIIPRGNALGMVQRLPETDEYSQNREQMESSIAVYMAGRVAEEIIFGRNKVTSGASSDIKGATNIARAMVTKAGLSDLIGPIFHGSSGDDMYGRQPNNETSEATAELIDAEVKRIITQGYEFAKDILTKHIDQLHTLANALIEYETLSGQQIKNLLSGRALDSEEENKFPFNDSSTIKIDKEKSPEKTKTTKAKKENSAS

SEQ ID NO: 14584 - protein, 257 aa, Glycine max; identical to SEQ ID NO: 3747

SEQ ID NO: 14585 - protein, 126 aa, Zea mays
FQRFEPGPPRRRGDRKAAKASPEGSRALRVARPRKEETLESTWKAITEGRGPPLARHLKKSDTWDARPGEVDPAAVAPAGAMRKAETFNDGGGAGRSKTPPAPVRREPSLGQDELNRRVEAFIHEF

SEQ ID NO: 14586 - protein, 292 aa, Musa acuminata
RHEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGNNDEKVLVLAATNTPYALDQAIRRRFDKRIYIPLPDLKARQHMFKVHLGDTPHNLTEKDFEYLARRTEGFSGSDISVCVKDVLFEPVRKAQDATFFCKTSDGMWVPCGPKQPGAVQTTLQELAAKGLGAKILPPPITRNDFEKVLARQRPTVSKADLEVHERFTKEFGEEG

SEQ ID NO: 14587 - protein, 610 aa, Zea mays; identical to SEQ ID NO: 8359

SEQ ID NO: 14588 - protein, 177 aa, Lactobacillus plantarum
NPVVYDPVVADSIEQYNELFLDPQNAAFVSVDAPEDIEATLKNARGRRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIATFNDDIQGT

SEQ ID NO: 14589 - protein, 400 aa, Campylobacter jejuni subsp. jejuni NCTC 11168
MFDEIRFNTIERLPNYVFAEVNAIKMAARRAGEDIIDFSMGNPNGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPCPKYVVVNFPHNPTTVTCEKSFYERLIATAKKERFYIISDIAYADLTYDDYKTPSILEIEGAKDVAVETYTLSKSYNMAGWRVGFVVGNKRLVSALKKIKSWFDYGMYTPIQVAATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 14590 - protein, 204 aa, Arabidopsis thaliana
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 14591 - protein, 196 aa, Yersinia kristensenii
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 14592 - protein, 484 aa, Saccharomyces cerevisiae
MSVHAATNPINKHVVLIDNYDSFTWNVYEYLCQEGAKVSVYRNDAITVPEIAALNPDTLLISPGPGHPKTDSGISRDCIRYFTGKIPVFGICMGQQCMFDVFGGEVAYAGEIVHGKTSPISHDNCGIFRNVPQGIAVTRYHSLAGTESSLPSCLKVTASTENGIIMGVRHKKYTVEGVQFHPESILTEEGHLMIRNILNVSGGTWEENKSSPSNSILDRIYARRKIDVNEQSKIPGFTFQDLQSNYDLGLAPPLQDFYTVLSSSHKRAVVLAEVKRASPSKGPICLKAVAAEQALKYAEAGASAISVLTEPHWFHGSLQDLVNVRKILDLKFPPKERPCVLRKEFIFSKYQILEARLAGADTVLLIVKMLSQPLLKELYSYSKDLNMEPLVEVNSKEELQRALEIGAKVVGVNNRDLHSFNVDLNTTSNLVESIPKDVLLIALSGITTRDDAEKYKKEGVHGFLVGEALMKSTDVKKFIHELCE

SEQ ID NO: 14593 - protein, 465 aa, Pterocladiella capillacea
AKMGYWDPDYTVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIASSGEIKGHYMNVTAATMEDMYERAEFAKQLGTVIVMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 14594 - protein, 405 aa, Ralstonia metallidurans
MTADSGKRRFARIDRLPPYVFNITAELKMAARRRGEDIIDMSMGNPDGATPPHIVAKLVDAAQRPDTHGYSASKGIPRLRRAISHWYRERYDVDIDPDKEAIVTIGSKEGLAHLMLATLDRGDTVLVPDPSYPIHIYGAVIAGADIRSVPLTPGIDFFAELERAIRGSYPKPKMIVLGFPSNPTAACVELDFFERVIALARKHDIFVVHDLAYADIVFDGWKAPSIMQVPGAKDIAVEFFTLSKSYNMAGWRIGFMVGNPDLVAALTRIKSYHDYGTFTPLQVAAIAALEGDQQCVKEIAAQYQSRRDVLARGLIESGWPVDIPKASMYIWARIPEPYRALGSLEFAKQLLAKAKVSVSPGIGFGDYGDEYVRFALIENESRIRQAVRGIKAMFRADGLVTAPGG

SEQ ID NO: 14595 - protein, 140 aa, Triticum aestivum
IGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISQLDERTQVAYGSKNEIIRFEETLYGSSRLAASATVGATA

SEQ ID NO: 14596 - protein, 498 aa, Yersinia pestis CO92
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 14597 - protein, 478 aa, Gracilaria crassissima
IKNERYESGVIPYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLAVNLPQGIFFEQDWASLRKVTPVASGGIHCGQMHQLLDYLGNDVVLQFGGGTIGHPDGIQAGATANRVALEAMVLARNESRDYVAEGPQILRDAAKTCGPLQTALDLWKDISFNYTSTDTADFVETPTANV

SEQ ID NO: 14598 - protein, 707 aa, Chloroflexus aurantiacus
LSSDSGVIGFPFQGLYTATKHAVEGFSDSLYQEVAPFGIHVSVVQPCGMFKTAMPANAIAQARSALKPDSPYADRVLRMASALSAAWETARDPAEVAQAILDVADADPPPIRRRVGAPERTGLLGLRQQMSHDDLVRFIYRLTAEPTPPPLPKVRGDGGWLVVRTLREAGITHAFTIVGGHNYQIVNACREEGLCVIDARNEMHAAHMADAFARLARRPALLTVDAAPGLVNAVAGIEVAYEAQVPMIVVSAQGSLAGRDIGVMQAIDQLRLVRPITKWQRTCFETRRLPEYTAAAIRHATTGRPGPTFLDFPLEVMQATIDVETVPQPRHYRVTSGPLADPDLLRQVIEMLRKARRPLIIAGSGVWWAHGEAELVRFVQTTGIPVLTRNLARGIIPDDHPLAAGFYPSPAALADAFLVIGTRLDWTIGYGRPPLFSPDAPVAQIDLHPESIGKTRPIEIGIVADAAQALRQLNAMVSATGPWTMDAEWPALAHGSIAAMRQQTAAAAQLSTRDQRPIHSIELMQALAECLPREAIKVVDGGYSAAFAIQYLDAYVPSGVLWVGSTGHLGVGLGFAIGAKRARPDAPVVAIMGDGAFGLCGMEFDTAVRHQLPIVVVVANDAGWGETRDGQRRRWGDAAIVGTALNPTRYDELARALGGHGEYVTRLDELAPAIRRAFAAGKPALINVITDPEQRSSAVSGLPWIVE

SEQ ID NO: 14599 - protein, 495 aa, Oryza sativa (japonica cultivar-group)
MAARSFSSASTTTILLRSGRWRRTMRAAAFPFRVSCSAAAAAAAGGTVVIGLAADSGCGKTTFVRRLTSVLGAGTAAAAAPPWGGNPGSNTLLGDAATVICLDDYHSLDRAGRKERGVTALDPRANDFDLMYRQLKAIKEGRAVAKPIYNHATGLLDPPELITPPKILVVEGLHPMYDERVRGLLDFSIYLDISSDIKFAWKIQRDMAERGHSLESIKASIEARKPDFDAYIDPQKQYADAVIEVLPTRLIAAADDDGDEGKVLRVKLIMKEGVEHFAPAYLFDEGSTISWIPCGRKLSCSYPGIKFSYFPDTYFGHEVSVLEMDGKFDKLDELIYVESHLSNLSTKYYGEVTQQMLKHADFPGSNNGTGLFQTIVGLKIRDLYEQPEDELLSLLQSLADMDITYKALQETDIGRHVNGLRKHPSGEVRLLAISSSSSSSASPWTGSSAAATAASWRESGSGSAMGSTTVVAVAGSTGISATSCFSLPWNPSPRW

SEQ ID NO: 14600 - protein, 214 aa, Oryza sativa
MAKLGPGQGLGCEAAVGLLAPSRKREYKACNKLTEGKRPLYAIGFNFLDFHYYEVFATVGGNRVTTYSCLKDGNFAILQAYIDEDKDESFYTLSWACDLDGTPLLVAAGSNGIIRVINCATEKLLKTFVGHGDSINEIRTQALKPSLIISASKDFHPSDIYRIASCGMDNTVKIWSMKAQSLPAARMAAYGDGMKWTIQKHEKYPYRQTMAMPD

SEQ ID NO: 14601 - protein, 220 aa, Zea mays
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFA

SEQ ID NO: 14602 - protein, 479 aa, Escherichia coli K12
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 14603 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 14604 - protein, 467 aa, Mazzaella rosea
  unsure (1)..(467): unsure at all Xaa locations
YAKMGYWDPDYVVKDTDVLALXRVSPQPGVDPVEASAAVAGESFTATWTVVWTDLLTACDLYRAKAYKVDTVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERFLYSMEGVNRAIAAAGETKGHYLXVTAVTXXXXXXXXXFAKQLGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAXATANRVALESMVIARNEGXDYVAEGPQILQDAPKTCGTLQTASKLWKNISFNYTPTDTADFVKXXXANFK

SEQ ID NO: 14605 - protein, 159 aa, Zea mays
PVACAETGVTLISPFVGRILDWYKKSTGKEYTAETDPGVKSVQRIFNYYKQHGYNTIVMGASFRNTGEITELAGCDYLTIAPKLLEELKNSDAKVPKKLDAAPADQAKEEKVSFVDNEAAFRWELFNDPMAFDKLHEGIRGFAKDGDACKEMLREKLRA

SEQ ID NO: 14606 - protein, 128 aa, Coccidioides posadasii
MGVVDALSRKSGVIVGDDVLRLFEYAQQNNFAIPAVNVTSSSTAVAALEAARDKKAPIILQMSQGGAAYFAGKGVTNTNQASIAGAVAGAHYIRSVAPIYAIPVVLHTDHCAKKLLPWFDGMLDADEK

SEQ ID NO: 14607 - protein, 538 aa, Arabidopsis thaliana
MAARRVSSLLSRSFSASSPLLFRSQGRNCYNGGILRRFGTSSAAAEEIINPSVQVSHTQLLINGNFVDSASGKTFPTLDPRTGEVIAHVAEGDAEDINRAVKAARTAFDEGPWPKMSAYERSRVLLRFADLVEKHSEELASLETWDNGKPYQQSLTAEIPMFARLFRYYAGWADKIHGLTIPADGNYQVHTLHEPIGVAGQIIPWNFPLLMFAWKVGPALACGNTIVLKTAEQTPLTAFYAGKLFLEAGLPPGVLNIVSGFGATAGAALASHMDVDKLAFTGSTDTGKVILGLAANSNLKPVTLELGGKSPFIVFEDADIDKAVELAHFALFFNQGQCCCAGSRTFVHEKVYDEFVEKSKARALKRVVGDPFRKGIEQGPQIDLKQFEKVMKYIKSGIESNATLECGGDQIGDKGYFIQPTVFSNVKDDMLIAQDEIFGPVQSILKFSDVDEVIKRANETKYGLAAGVFTKNLDTANRVSRALKAGTVWVNCFDVFDAAIPFGGYKMSGNGREKGIYSLNNYLQIKAVVTALNKPAWI

SEQ ID NO: 14608 - protein, 355 aa, Escherichia coli
  unsure (1)..(355): unsure at all Xaa locations
STVTITDLARENVRNLTPYQSARRLGGNGDVWLNANEYPTAVEFQLTQQTLNRYPECQPKAVIENYAQYAGVKPEQVLVSRGADEGIELLIRAFCEPGKDAILYCPPTYGXYSVSAETIGVECRTVPTLDNWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLXKVIAPYPLSTPVADIAAQALSPQGIVAXRERVAQIIAEREYLIAALKEIPCVEQVFDSETNYILARFKASSAVFKSLWDQGIILRDQNKQPSLSGCLRITVGTREESQRVIDALRAEQV

SEQ ID NO: 14609 - protein, 243 aa, Methanosarcina barkeri
MRLAVIEGDGIGREIIPAAVKVLDAFGLEFEKVPLELGYTRWERTGTAISNNDLETIKGCDAVLFGAITTVPDPNYKSVLLTIRKELDLYANVRPVKPLPGITGVTGRNDFDFIIVRENTEGLYSGIEEIGPELSWTKRVVTRKGSERIAEYACKLAKKRKNKLTIVHKSNVLKSDKLFLDVCRQTASANGVEYEDMLVDSMAYNLIMRPERYDIVVTTNLFGDILSDMCAALVGSLGLSQAP

SEQ ID NO: 14610 - protein, 233 aa, Oryza sativa
MAAAAVDPMALGLGTSGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQRWGMIRRMGSS

SEQ ID NO: 14611 - protein, 430 aa, Bacillus subtilis subsp. subtilis str. 168
MLEKRTPIPVDEAVRRVCHFQKQGETEWVALEDSLHRFLAEDITADHHVPAFDRSPYDGFAVRACDTAEASRENPVRFEVIDHIGAGAVSEKELGPFQAVRIMTGAQIPEGADAVVMIELTQAFEENGKSFMSLKRRFQTGDNISKTGEDAQKGSVLLTKGTRVTPGVTALLATFGYASVPVVRKPVVGIIATGTELLNVSDPLEPGKIRNSNASMVYAQAIEAGATPLYLGKISDELDKSFAAVKEAMKKVDFLITTGGVSVGDFDFLPAIYEKLGADVLFNKVAMRPGSVTTVAHANDMLLFGLSGNPSACYVGFELFVKPIIQTWLLNETPHSICAEAVLTKDFPKPNPFTRFVRALVHHQEGKLLATPVGLDKSSSVTSLADANAFIILPGGTRGYESGRTVQVLLIREENGSEWPWSVLSRSSKL

SEQ ID NO: 14612 - protein, 466 aa, Burkholderia fungorum
MRHRTRHESNLCSACRQPDCDCSRFCRPGERRHPRRTDQGLPRRRHALLRRGDPQQREDHRLHEAACRRTQPRVPRDVQGSRQSRRQTRLAVMSARPACAIRPLDSRGVVESLVSDFRSRRMCDLREPGSRLPHSLLPRGARQTQPLAKDWNKLPMTRPTTQIFDAAATARLIPYAALVAALKRASIEYAQQRIASPERLVVPLNEGGIMLSMPATAPDLAIHKLVNVCPANGPRGLPTIHGKVMTFDADTGETLFILDGPIVTGRRTAAISMLGVETFAAAAPREFLLIGTGTQALNHLEAIGELFPEARVWVKGSAPARAEAFCAQHHDKAREIRPFTQDGAAIPESVDVVIALTTSRQPIYDEAARAERLVIGVGAFTPAMVEIGARTIAGSALFVDDEAGARHEAGDFIQAGVDWAQVGGIASVLGNPALRPQKEPVVFKSVGCAAWDLAACRVAREALSGG

SEQ ID NO: 14613 - protein, 463 aa, Glycine max
PRVRESQANGVHSSKHDDDGRLKRRGTWLTATSHIVTAVIGSGVLSLAWAVAQLGWIAGPAILTIFSVITVFTSSLLSDCYRYPDSVHGTRNHNYREMVKNILGGRKYLFCGLAQFANLIGTGIGYTVTASISMVAVIRSNCFHKYGHEAKCHTSNYPYMTIFAVIQILLSQIPDFQELSGLSIIAAVMSFGYSSIGIGLSIAKIAGGNDAKTSLTGLIVGEDVTSQEKLWNTFQAIGNIAFAYAFSQVLVEIQDTLKSSPPENQAMKKATLAGCSITSLFYMLCGLLGYAAFGNKAPGNFLTGFGFYEPYWLVDIGNVFVFVHLVGAYQVFTQPVFQLVETWVAKRWPESNFMGKEYRVGKFRFNGFRMIWRTVYVIFTAVVAMILPFFNSIVGLLGAISFFPLTVYFPTEMYLVQAKVPKFSLVWIGVKILSGFCLIVTLVAAAGSIQGIIADLRIYEPFK

SEQ ID NO: 14614 - protein, 474 aa, Sorghum bicolor
MVTAWLRWSCRLHQPSTCSYHLGEVISLPPCQSAYRFCLEVNFSILWQSAAPPQPRRKRPPREVTVPVAAASNPKPRPPPVQSKENQAEGGAAAEGAAAEEGEKYRPAPEILPLPPAMAKLGPGQGLGCEAAEGSLVPSRKREYKPCGKHTEGKRPLYAIGFNFMDARYYDVFATVGGNRVWGVLVDTGKLTTYRCLENGSFALLQAYIDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIEIQKKLTALITIHCKQAIVKEKYTCGKYSRALLS

SEQ ID NO: 14615 - protein, 259 aa, Glycine max
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQLASTTAEAELAPTHPIRLGLALNFSVFYYEILNSPERACHLAKQAFDEAISELDTLSEESYKDSTLIMQLLRDNLTLWTSDIPEEGAEEQKVDSARAAGGDNA

SEQ ID NO: 14616 - protein, 468 aa, Agarum clathratum
IPYAKMGYWDADYNVKDTDILALFRITPQRGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNVTAATMEQMYERAEYAYSIGTVIVMIDLVVGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAAATCGPLKAALDLWKDITFEYTSTDTPDFVESTTESN

SEQ ID NO: 14617 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALDAKFGCSVPLLLMNSFNTRDDTLRIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGRVQLLEIAQVPDEHVNEFKSIEKFKIFNTNNLWVNLSAIKRLVEADALKMEIIPNPKEVDGVKVLQLETAAGAAIKFFDRAIGANVPRSRFLPVNATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 14618 - protein, 303 aa, Streptomyces coelicolor A3(2)
MTQSHPRISKAVIPAAGLGTRFLPATKATPKEMLPVVDKPAIQYVVEEAVTAGLGDVLMVTGRNKRPLEDHFDRNYELESALQKKGDASRLAKVQESSDLAMMHYVRQGDPKGLGHAVLCAAPHVGHEPFAVLLGDDLIDPRDPLLQRMIDVQEQYGGSVIALMEVAPEQIHLYGCAAVESTADSDVVKVGGLVEKPDPADAPSNYAIIGRYVLDPHVFDILRKTEPGRGGEIQLTDALQQLAEDESVGGPVHGVVFKGRRYDTGDRGDYLRAIVRLACEREDLGPDFRTWLRSYVAEEMQGR

SEQ ID NO: 14619 - protein, 337 aa, Pseudomonas sp. 7A
KEVENQQKLANVVILATGGTIAGAGASAANSATYQAAKVGVDKLIAGVPELADLANVRGEQVMQIASESITNDDLLKLGKRVAELADSNDVDGIVITHGTDTLEETAYFLNLVQKTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRVVPALQQLRKNGTQIIRSSHVNQGGFVLRNAEQPDDKNDWVVAHDLNPEKARILAMVAMTKTQDSKELQRIFWEY

SEQ ID NO: 14620 - protein, 298 aa, Oryza sativa
ILKQNIVISKVCALALLTSPTRSLLVVRCLHDFPVRPGRPISSARVFLYQHFLSDDEANHLVSLARTELKRSAVADNLSGKSELSDARTSSGTFIRKSQDPIVAGIEEKIAAWTFLPKENGEDIQVLRYKHGEKYERHYDYFSDNVNTLRGGHRIATVLMYLTDVAEGGETVFPLAEVISLRGTNNEDSTLSECAKKGVAVKPRKGDALLFFNLSPDASKDSLSLHAGCPVIKGEKWSATKWIRVASFDKVYHTQGNCTDDNESCEKWAALGECIKNPEYMIGTAALPGYCRKSCNIC

SEQ ID NO: 14621 - protein, 181 aa, Mycobacterium tuberculosis H37Rv
MKVAAQCSKLGYTVAPMEQRAELVVGRALVVVVDDRTAHGDEDHSGPLVTELLTEAGFVVDGVVAVSADEVEIRNALNTAVIGGVDLVVSVGGTGVTPRDVTPEATRDILDREILGIAEAIRASGLSAGIVDAGLSRGLAGVSGSTLVVNLAGSRYAVRDGMATLNPLAAQIIGQLSSLEI

SEQ ID NO: 14622 - protein, 180 aa, Zea mays
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDIKK

SEQ ID NO: 14623 - protein, 317 aa, Glycine max
MGSEVSKQVERRKAIHTEGKTLSDLRNSGEDYPGSDYHPSDRKKWMSELNPEKVVIKQIVWPGTHDSATNKIGIPCITRPFAQCQSLSIYQQLVLGTRVIDIRVQEDRKVCHGVLVTYSIDVVIKDLKKFLSETQSEIIILEVRTEFGHEDPQEFDKYLEEQLGDYLVPQDDKVFEKTIAEVLPKRVICVWKPRKSPQPKAGSPLWSAGYLRDNWINTDLPSTKFESNMKHLSEQQPVTSRKYFYRVENTVTPVADNPVLCVKPVTERIHGFARLFISQCFSKGYADRLQIFSTDFIDQDFVDACVGLTRARVEGRA

SEQ ID NO: 14624 - protein, 162 aa, Neurospora crassa
MPENYPVQKSADEWRAVLSPQQFRILREKGTEPAGTGKFDKHYPSAGVYTCAGCHAPLYKASHKFNSGCGWPAYFDSIPGAVTRHEDRTFGMTRTEIVCSNCGGHLGHVFKGEGFNTPTDERHCVNSISLSFSEEDSAAEKKGDGERSGEKTLDCIQSLHSR

SEQ ID NO: 14625 - protein, 421 aa, Zea mays
  unsure (1)..(421): unsure at all Xaa locations
MAAAAAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLXREVAKSAITDNALPSSPVTASEASKPSDDFPEFKLSDAPAPPAENLNGKHEPKSPKAAPRSPKAATHPTFATGVIKPIVSFFVGGKTGGLGVRKLTTXPNESLVEQKPEEPKPAIPALTAPTAKGGSSLHSRFEYVDNEQSSVSRTGGSGSRVTCHVAPPKSFDYFQEYGTGNGFQMKSSNASKAQIEETDXARKKFSNAKAISSSQFFGTQNREEKEAQLSLQKFAGSSSISSSDLFGRTNVDDSNLDLSAADLINRISFQASQDLSSLKDIAGETGKKLTSFASNFISDLDRIL

SEQ ID NO: 14626 - protein, 413 aa, Corynebacterium glutamicum ATCC 13032
MLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 14627 - protein, 313 aa, Mastigocladus laminosus
NGFGRIGRLVFRAGITNPNIEFVGINDLVPPDNLAYLLKYDSTHGIYKGKVEAKDNGIIVDGHFVPCVSMRNPAELPWGKLGADYVVESTGLFTNYEGAANHLQAGAKRVVISAPTKDPDRVKTLLMGVNHQLFDPAKDTVVSNASCTTNCLAPIAKVINDNFGLTEGLMTTVHAMTATQPTVDGPSKKDWRGGRGAAQNISLSTGAAKAVALVLPELKGKLTGMAFRVPTPDVSVVDLTFKTAKATSYQEICAAMKAAATGELKGILGYTDEEVVSTDFQGDTHSSIFESGAGIELNSNFFKVVAWYDNEWG

SEQ ID NO: 14628 - protein, 316 aa, Rhodobacter sphaeroides
MPTYDVSSIGFYVCDILGRPVTRIPDGGRADYIQEIRMTVAGTAGATAADCAILGLKTLAVTTVGEDEMGDFMVAKLTRFGVDCAMVARDGSVQTSATILPVRPNGERPALHVPGTAATFRIPEGRLDAALDARIVHVGGTGLLKSFDGAPTVEALRRAKELGRITTFDLIQATPETFELVRPCLPYIDYFVPSIEEASEMAGTTDPAEVARFFKGLGVKNAILTMGGEGVYVSPEAGEDFRLPAHAIEVVDTTGCGDSFTAGVIVGLARGWDLRDCCRFASAVAARVAMGLGSDGKLVSFEDTIEAMNTLPLRAN

SEQ ID NO: 14629 - protein, 330 aa, Zea mays; identical to SEQ ID NO: 491

SEQ ID NO: 14630 - protein, 141 aa, Triticum aestivum
MKSAPTMDPEAAAAPGTPPETAPRRGEGRKRLPWRMTLSLAYQSLGVVYGDLSTSPLYVYKAAFADDIQHSETNEEILGVLSFVFWTLTLVPLLKYVCVVLRADDNGEGGTFALYSLLCRHARAALLPPGRGAKPGDQDQF

SEQ ID NO: 14631 - protein, 306 aa, Prochlorococcus marinus str. MIT 9313
MHQFLPYAWFQGACVPFEEAKISVATHALHYGTGAFGGMRAIPDPQNSNTMLLFRADRHAKRLSQSARLLLTELSETRILSALEAMLQANRPTTPIYLRPFVYTSDLGIAPRLHNIETDFLIYGLELGDYLSPEGVSCRISSFTRQEDRSLPLRGKISGAYITSSLAKTEAVLSGFGEALLLNSRGKISEASGMNLFLVRDGQLITPGVDQDILEGITRSSVLELARVMGLSVIERPVDKTELFIADEVFLTGTAAKITPIRQIESTILATERPIMNALRDRLIEITQGRDKDYEHWITRICMTND

SEQ ID NO: 14632 - protein, 925 aa, Medicago truncatula
MMELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSEREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 14633 - protein, 360 aa, Eremothecium gossypii
MGVQDVLKRKQGVIVGDDVRALFSYAREHKFAIPAINVTSSSTVVAALEAARDSKSPIILQTSNGGAAYFAGKGVSNEGQYAAVQGATAAAHYIRSIAPAYGVPVVLHTDHCAKKLLPWYDGMLEADEAYFKEHGEPLWSSHMLDLSEETDDENIATCVKYFQRMAKMGQWLEMEIGITGGEEDGVNNEHVEKDALYTSPETVFAVYEALAPISPNFSIAAAFGNVHGVYKPGNVVLSPEILGEHQQYAAAKVGGSEAKPLYLVFHGGSGSTQQEFNTAISNGVVKVNLDTDCQYAYLQGIRDYVLNKKDYIMSMIGNPEGEDKPNKKFFDPRVCVREGEKTMTKRIAEALQVYHSVNQL

SEQ ID NO: 14634 - protein, 757 aa, Avena strigosa
MWRLTIGEGGGPWLKSNNGFLGRQVWEYDADAGTPEERAEVERVRAEFTKNRFQRKESQDLLLRLQYAKDNPLPANIPTEAKLEKSTEVTHETIYESLMRALHQYSSLQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 14635 - protein, 197 aa, Yersinia bercovieri
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 14636 - protein, 506 aa, Zea mays
MAKGGAVVGTAVVVCAAAAAAVGVAVVLSRRRSRRREAEDERKRKAAAVIEEVEQRLSTPTALLRGIADAMVEEMERGLRAEPHAPLKMLISYVDNLPTGDEHGLFYALDLGGTNFRVIRVQLGGRDRRVVKQQYEEVSIPPHLMVGTSTELFDFIAAELEKFVRTEGEDFHLPDGKQRELGFTFSFPVHQTSISSGTLIKWTKGFCINGTVGEDVVAELSRAMERQGLDMKVAALVNDTVGTLAGGRYADNDVVAAVILGTGTNAAYVEHANVIPKWTGLLPRSGNMVINMEWGNFRSDKLPRSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLGDFSQQRTVVAIDGGLYEHYKKFSACLEATLTDLLGEEVASSVVVKLANDGSGIGAALLAASHSQYAEAA

SEQ ID NO: 14637 - protein, 162 aa, Zea mays
HSRKKPLVSARFSRKATKPSPEGSRALRVARPRKEETLESTWKPMSAEGRGPTLARRLKKSDTWDTRPGRRPSGGGSSGEVDPAAVAPAGAMRKAETFNDGGAGRSRPAPAALVRREPSLGQDELNRRVEAFIHKFNMEMRLQRQESLKRYNDMIGRGRGSR

SEQ ID NO: 14638 - protein, 449 aa, GIBBERELLA ZEAE PH-1
MKSRALHQVALRRAILSRPHVTPLAIRSASSVSQRPNSNFVSFPGALKSAFTSNLKFESPESYPALSTYRVVDQHGVVVDESFKPDISNEEVIRLYKDMVFISIMDLIMFDAQRQGRLSFYMVSAGEEAVSIGSSSVLDREDVMFTQYREQGVFKERGFTAKDFMGQLFGNVRDPSRGRSMPVHYGSKELNIHSVSSPLATQLPHASGAAYALKMQKLQNPSSKARVAVAYFGEGAASEGDFHAALNIAATRACPAIFICRNNGYAISTPTLDQYRGDGIASRGIGYGIDTIRVDGNDIWAVREVVKKAREMALEDGGKPILIEAMTYRVSHHSTSDDSFAYRARVEVEDWKRRDNPITRLRKWMEAQGIWDEAKEKEARTDLRKEILKAFSEAEREKKPPMRSMFEDMYEEMTDDLKAQMKELKEMLDKYPEEYDVSEFEGGKDTLKP

SEQ ID NO: 14639 - protein, 360 aa, ASPERGILLUS NIDULANS FGSC A4
MGVLEKLSRKTGVIVGDDVLRLFEYAQEHNFAIPAINVTSSSTVVACLEAARDQNCPVILQVSQGGAAFFAGKGVSNDGQAASIAGGIAAAHYIRSIAPSYGIPVVLHTDHCAKKLLPWLDGLLDADEAYFKQHGEPLFSSHMIDLSEEPVDYNIDTTAKYLKRAAPMKQWLEMEIGITGGEEDGVNNESVDNNSLYTQPEDILAIHNALSKISPYFSIAAGFGNVHGVYKPGNVRLHPELLSKHQAYVKEQTGSKKDKPVFFVFHGGSGSSKEEYKEAISYGVVKVNLDTDMQYAYLSGVRDYVLNKKDYLMSTVGNPDGEDKPNKKFFDPRVWIREGEKTMSKRVQVALEDFNTAGKL

SEQ ID NO: 14640 - protein, 419 aa, Cryptonemia luxurians
ETDVLALFRVTPQPGVDPVEASAAVAGESSTATWTVVWTDLLTACDLYRAKAYKVDAVPNSSDQYFAYVSYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEVKGHYMNVTAATIENMYERAEFAKQLGTVIIMIDLVVGYTAIQTMGIWARKNDMILHLHRAGNSTYSRQKSHGMNFRVICKWMRMAGVDHIHAGTVVGKLEGDPLMIRGFYNTLLFTHLDVNLPQGIFFEQDWASLRKVTPVASGGIHCGQMHQLLDYLGEDVVLQFGGGTIGHPDGIQAGATANRVALESVVVARNEGRDYVAEGPQILQDAAKTW

SEQ ID NO: 14641 - protein, 373 aa, Zea mays
MALDTADADAPRLRLDASAAVHPLLSDDGSTAAGETAEQLDARYAPYARRDAYGTMGRGPLPAAQAVRLALAAAVLLPLRFVAGMLVLLLYYLVCRACTLFVDADGGRPRLAGWRRKAVLRSGCALSRVMLFVFGFYWIRETRRRSTNAKGLNQDQFEESQRPGAIVSNHVSYVDILYHMSASFPSFVAKESVSRLPLIGLISNCLGCIFVQRESKSSEAKGVSGAVTERIQDVCQDKNTPMMLLFPEGTTTNGDYLLPFKTGAFLAGAPVQPVILKYPYRRFSPAWDSMDGARHVFLLLCQFVNHMEVVRLPVYYPSQLEKEDPKLYANNVRKLIAMEGNLVLSNIGLAEKRVYHAALTGSSLPGARHEKDD

SEQ ID NO: 14642 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 14643 - protein, 310 aa, Neurospora crassa
MTQPNAIDEEDYDYESLPPNFSLIQNMAAGAFAGIAEHCAMYPIDAVKTRMQIVNSNPSAVYHGVIQSTYRIASTEGIFSLWRGMSSVIAGAGPAHAVYFATYEAVKHLMGGNKVGEHHFLAAATSGACATIASDALMNPFDVIKQRMQIQNSAKMYRSMLDCAKYVYRNEGLGAFYVSYPTTLSMTVPFTALQFLAYESISTSMNPTKKYDPATHCLAGAVAGGFAAALTTPMDVIKTMLQTRGAAQDAEVRAVNGFVAGCKLLYRREGVKGFFKGLKPRVLTTMPSTAICWSAYEASKAYFIHQNSQS

SEQ ID NO: 14644 - protein, 634 aa, Alicyclobacillus acidoterrestris
MTKQLLDTPMVQATLEAGVAHLLRRQAPDGYWWAPLLSNVCMEAEYVLLCHCLGKKNPEREAQIRKYIISQRREDGTWSIYPGGPSDLNATVEAYVALKYLGEPASDPQMVQAKEFIQNEGGIESTRVFTRLWLAMVGQYPWDKLPVIPPEIMHLPKSVPLNIYDFASWARATIVTLSYRHESPTCDATSGLCKGSGIVRGEGPPKRRSAKGGDSGFFVALDKFLKAYNKWPIQPGRKSGEQKALEWILAHQEADGCWGGIQPPWFYALLALKCLNMTDHPAFVKGFEGLEAYGVHTSDGGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTKSDSIFATSGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGEDCRSYDDPRLAGQGVSTPSQTAWALMALIAGGRVESDAVLRGVTYLHDTQRADGGWDEEVYTGTGFPGDFYLAYTMYRDILPVWALGRYQEAMQRIRG

SEQ ID NO: 14645 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKHDLKEGQ

SEQ ID NO: 14646 - protein, 319 aa, Zea mays
  unsure (1)..(319): unsure at all Xaa locations
RAGDPDEPGKPLTFXEITSNDPTKPSKTALAFGLPGNPVSCMVCFNLFVVPAIRLVSGWSNPHLERVHVRISHPLRADPHRMEFHRAVIRWVLDDGSGRPGYVAESTGQQASSRLLSMKSANALLEVQSSEQILAAGASVQAILISDITSPPLDKLPAASSPLSSHLVSSAKGALADAPQVAASQNAEVKVAILTVSDTVSSGAGPDRSGPRAVSVVNSSSEKLGGAVVATAVVPDEVDKIKEILVKWSDIDRVNLILTLGGTGFTPRDVTPEATKSVIEKEAPGLAFVMIQESLKVTPFXAMLSRAACGIRGSTLIIN

SEQ ID NO: 14647 - protein, 477 aa, Hymenena palmata
KNDRYESGVIPYAKMGYWDPDYVIKETDVLALFRVSPQPGVDPIEASAAVAGESSTATWTVVWTDLLTACDLYRAKAYKVDAVPNTTDQYFAYISYDIDLFEEGSIANLTASIIGNVFGFKAVKALRLEDMRLPVAYLKTFQGPATGIIVERERMDKFGRPFLGATVKPKLGLSGKNYGRVVYEGLKGGLDFLKDDENINSQPFMRWKERFLYSMEAVNRSIAGTGEVKGHYMNVTAATMEEMYERAEFAKQLGSIIIMIDLVIGYSAIQTMGIWARRNDLILHLHRAGNSTYSRQKIHGMNFRVICKWMRMAGVDHIHAGTVVGKLEGDPLMIKGFYDTLLLPHLDLNLPLGIFFTQDWASLRKVTPVASGGIHCGQMHQLLDYLGNDVVLQFGGGTIGHPDGIQAGATANRVALESMVIARNEGRPYVEEGPQILRDAAKTCGPLQTALDLWKDITFNYTSTDTADFVETPTANV

SEQ ID NO: 14648 - protein, 399 aa, Spinacia oleracea
MALNLNPVSTPFQCRRLPSFSPRQTPSRRSPKFFMASTLSSSSPKEAESLKKPFSPPREVHVQVTHSMPQEKIEIFKSLEGWAEENLLVHLKPVEKCWQPQDYLPDPASEDFRDQVKEIQERAKEIPDDLYVVLVGDMITEEALPTYQTMLNTLDGAKDETGASPTSWAVWTRAWTAEENRHGDLLNKYLYLSGRVDMRSIEKTIQYLIGSGMDPRTENNPYLGFVYTSFQERATFVSHGNSARLAKEHGDLKMAQICGIIASDEKRHETAYTKIVEKLFEIDPDATVLAFADMMKKKISMPAHLMYDGRDDNLFDHFSAVAQRLGVYTAKDYADILEFLVGRWEVEKLTGLSSEGQKAQDYVCSLPPRIRRLEERARERAKQAPSMPFSWIFDRQVKL

SEQ ID NO: 14649 - protein, 361 aa, Kluyveromyces lactis
MLRQGIAAQKKSFATLAAEQLLPKKYGGRYTVTLIPGDGVGKEVTDSVVKIFENENIPIDWETIDISGLENTENVQRAVESLKRNKVGLKGIWHTPADQTGHGSLNVALRKQLDIFANVALFKSIPGVKTRLNNIDMVIIRENTEGEYSGLEHESVPGVVESLKIMTRAKSERIARFAFDFALKNNRKSVCAVHKANIMKLGDGLFRNTVNEIGANEYPELDVKNIIVDNASMQAVAKPHQFDVLVTPNLYGSILGNIGSALIGGPGLVPGANFGREYAVFEPGSRHVGLDIKGQNVANPTAMILSSTLMLRHLGLNAYADRISKATYDVISEGKSTTRDIGGSASTSEFTNAVIEKLAKL

SEQ ID NO: 14650 - protein, 518 aa, Oryza sativa (japonica cultivar-group)
MAGGAVVSTGAGKDYPGKLTLFVFFTCVVAATGGLIFGYDIGISGGVTSMDPFLRKFFPEVYRKKQMADKNNQYCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQP

SEQ ID NO: 14651 - protein, 420 aa, Zea mays
  unsure (1)..(420): unsure at all Xaa locations
PPAQVDVGLSDGSFARGAVPSAQXGASTDDVIYEALELRDGGSDYLGKGVLKAVNNVNSIIGPAIVGKLDGTSNEWGWCKQKLGANAILAVSLAVCKAGAMVQKIPLYQHIANLAGNKTLVLPVPAFNVINGGSHAGNKLAMQEFMILPTGASFKEAMKMGVEVYHHLKSIIKKNXKKYGQDATNVGDEGGFAPNIQENKKGLELLKAAIEKAGYTGKVFIGMDVAASEFFSEKDKTYDLNFKEENNDGSNKISGDSLKDLYKSFVSEYPIVSIEDPFDQDDWTTYAKLTGEIGQQVQIVGDDLLVTNPTRVAKAINEKTCNALLLKVNQIGSVTESIEAVRMSKRAGWGVMASHRSGETEDTFISDLSVGLATGQIKTGAPCRSERLAKYNQLXLRIEEELGVAAVHAGAKFRAPVEPY

SEQ ID NO: 14652 - protein, 89 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEDEVPLRPVG

SEQ ID NO: 14653 - protein, 542 aa, Arabidopsis thaliana
MASKSDVNIIETSSKVHFSGFHQMDGLASNRPEQMAEEEEHGQPFVIGESRGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDAGLSHTKPVNTYVVKSVAYMRRCTCICTHEDADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGKLMKKIIPYYNLGEELSNHRSVYSGVDFCKKLCGVSVIRSGESMENALRACCKGIKIGKILIHREGDNGQQVCVLSLLITSPNYLLTTNGTHQLIYEKLPSDISERHVLLLDPILGTAGNSAVQAIRLLISKGVPESNIIFLNLISAPEGVNVVCKKFPRIKIVTSEIELGLNDEFRVVPGMGEFGDRYFGTDDE

SEQ ID NO: 14654 - protein, 387 aa, Zea mays
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 14655 - protein, 539 aa, GIBBERELLA ZEAE PH-1
MDKQIESIKDKLDECGAVTEEHAGMSMALEPYGPSGFRGLFSSPYVAACAAFSAIGGLLFGYDQGVISVTLVMDHFLERFPEVSDDAPGAGFKKGLMTAMITLGAFIGAINQGWIADWISRKRSLMVAVVIFTVGSTLQTAAINYAMLVVGRFIGGIGIGQLSMVVPLYISEISPPEIRGSLLVFEQLSIVIGIVVAFWITYGTKLPFLLQILPGLLLGFGAIFLPYSPRWLASKDREEEALLNLAKLRALPESDPRVQREILDIIAEARFQASALRERHPNLTQRTDLGGKIRLALFSRADCFKPGCWRRTLVGAGLMFFQQFTGINALIYYSPTLFGTMGLGFEMQLIMSGVLNVTQLVGVLTSLWTMDRFGRRSILLVGSLLMFVPHLIIAILVGVFSKDWPSHTAEGWTSVAFLLCYMFTFGASWGPVPWAMPAEVFPSSLRAKGVAISTCSNWINNFIIGLITPPLVRSTGFGAYVFFAVFCLLSFVWVWFSVPETNGKSLEEMDEVFNDRTGTADIAKKDRIMADLYTERQNR

SEQ ID NO: 14656 - protein, 124 aa, Pectobacterium carotovorum subsp. carotovorum
LPFGIVRNWHEQIAVTCRKACIGIITNPVNTTVAIAAEVLKKAGVYDKNKLFGVTTLDIIRSNTFVAELKGKQPQDINVPVIGGHSGVTILPLLSQVPGISFNEQEVADLTKRIQNAGAQVVKA

SEQ ID NO: 14657 - protein, 528 aa, Oryza sativa (japonica cultivar-group)
MDSARSWFTKLQTREKSIGKKKELPPNGKEGTDEAPSSATKQRVAAAKQYIEKHYKEQMKNLQDRKERRCSLEKKLADANVSEEEQHNIVKQFEKKETEYMRMQRHKMSVDDFDLLTMIGKGAFGEVRVCREKNTGNVYAMKKLRKSEMLRRGQVEHVKAERNLLAEVDHHCIVKLYCSFQDSEYLYLIMEYLPGGDMMTLLMRKDTLTEDEARFYVGETVLAIEAIHRHNYIHRDIKPDNLLLDRHGHLRLSDFGLCKPLDYSNFPDLNEKDVTSTKPQSTNGDGRQQSMPKRTQQEQLEHWQKNRRTLAYSTVGTPDYIAPEVLLKKGYGMECDWWSLGAIMYEMLVGYPPFYSDEPMTTCRKIVNWRTHLKFPEEARLMTDAKDLISKLLCNVDQRLGTKGAEEIKEHSWFSGVEWDKLYEIEAAYQPQVTDELDTQNFEKFEESSDNIQCSAKAGPWRKMLSSKDLNFVGYTYKNFELVNDPEVLGMAELKKKEKAKRPSAKSLFGIPSRALAVLCSSSIRRHI

SEQ ID NO: 14658 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 14659 - protein, 154 aa, Glycine max
SARGPAYYKRGDYVPGLKVDGMDALAVKQACKFAKEFALKNGPIILEMDTYRYHGHSMSDPGSTYRTRDEISGVRQERDPIERVRKLLLTHEIATEKELKDIEKEIRKEVDEAIAKAKESQMPEPSDLFTNVYVKGFGVEACGADRKEVRAILP

SEQ ID NO: 14660 - protein, 370 aa, Zea mays
  unsure (1)..(370): unsure at all Xaa locations
GRPGSHSPTPSSISFQIHPSSFPPSRSISTPWAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKXVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKXEAEGSLKGILGYVEEDLVSTDFQGDSRSSIFDAKXAGIALNGNFVKLVSWYDNEWGYSTRVVDLIRHMNSTN

SEQ ID NO: 14661 - protein, 463 aa, Chondrus ocellatus
MGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAGTMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGVDVVLQFGGGTIGHPDGIQAGATANRVALESMVIARNEGRDFVAEGPQILQDAAKTCGPLQTALDLWKDISFNYTSTDTADFVETPTANV

SEQ ID NO: 14662 - protein, 466 aa, Magnetospirillum magnetotacticum
MSMSDELRDAALEYHRLPTPGKISVTPTKPLATQRDLALAYSPGVAAACELIVADEDSAADVTARGNLVAVVTNGTAVLGLGPIGPLAAKPVMEGKGVLFKKFAGIDVFDMELAELDPDKLVDIIAAMEPTFGAINLEDIKAPECFEVERKLQERVKIPVMHDDQHGTAIVVGAAMVNALRVVGKDIGEVKLVASGAGAAALACLNLLCKLGVKRENVWVTDIKGVVYEGRTELMDQYKSIYSKKTDMRTLAEVIEGADIFLGLSAPRVLTGEMVDKMAQKPIVFALANPTPEILPDEVKAVRPDAIIATGRSDYPNQVNNVLVFPYIFRGALDVGATQINDEMKLACVYALANLAMAESDERVRAAYGTAPLTFGPEYLIPKPFDSRLIIKIAPAVAKAAMESGVARRPIIDFDVYMDRLNQFVFRSGLVMKPVFDRARQDMRRIVYTEGEGRRVLHAVQTVVDE

SEQ ID NO: 14663 - protein, 492 aa, Helianthus annuus
MDPYKQRPSSAYNAPFWTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLYLQVIDPDHEDRLDFDPLDGTMTWPEDIIPLQPVGRMVLNKNIDNFFAENEQLAFNPGLVVPGIYYSDDKMLQGRIFAYSDTQRHRLGPNYLQLPVNAPKCAHHNNHYDGNMNFMHRDEEVDYFPSRYDRVQHAKQYPINSRQVTGTRDRTVIPKYNDFKQPGDRYRSWDPARQERFIVRMCKMLSDPRVTHELRSIWISYWTQADQSLGQKIASRLNVRPNY

SEQ ID NO: 14664 - protein, 753 aa, Oryza sativa
MERTKKNATVPPPPRLAARLLASSTSGPSGAGGGAAGRSGGGRSGAGKERRRPEWGGKERARHPDEEAKEQEVRGHGVGGSRRGAARHDEACPRDLPDGPHHLQLPRHLPVARLDGVENGRVPVVDPPEAAPCRRVAERDNGLLRTAASGATVPSVAATLSEMVARKLSVDSDEDKDSFMHLVSRYLIREEKEMIDWNKVERPTPEMVVPYDSLVQAPRDIPEIRNLLNKLAVLKLNGGLGTTMECVAPKCTIEVRSGLTFLDLAIMQTEIVEKYTNIEIHTFNQNKYPRIITEKFLPLSSEGSTGSHCWYPPGHGDVFFSLCKSGILDTMLSQGKEYVFIASSENLGATVDIEIESLTSTEILNHLIHNKNEYCMELLEIFQVPYENVAFGYRRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKHSTHSSGAIKYTMKLDEGADCASIDSALNRLNPGSTLILKKDDFYRYIDPIQARNRAMFHSESNCIITATLKDNWFAKLVQGKLWLIILVFHQFKLLSRRRLRWGERRRRTLRSIHQDIQSYLDNYSDSDMWHLIVHSVARVISNVLEDVNRKYMKNHYLGFLAIHSTVFAIEVIGSYAVELNYDIEHYAEPPEL

SEQ ID NO: 14665 - protein, 262 aa, Fritillaria cirrhosa
MSSAESREENVYLAKLAEQAERYEEMVEFMEKVAKTVETEELTVEERNLLSVAYKNVIGARRASWRIMSSIEQKEESKGNDQNVKLIKGYRHKVEEELAKICNDILTVIDKHLIPSSGSGEATVFYYKMKGDYYRYLAEFKNEHERKEAADQSMKAYQAASNTANTDLPSTHPIRLGLALNFSVFYYEIMNSPERACHLAKQAFDEAIAELDTLSEESYKDSTLIMQLLRDNLTLWTSDLPEDGGDEGFKGEEAKAAGDDEH

SEQ ID NO: 14666 - protein, 446 aa, Tortula ruralis
MGQGQSGGLPKQGPGGERNKGDGQKKEKKYEPAAPPTRVGRKQRKQKGSEAAARLPVVTPATKCNLRLLKLDRAKDYLLMKEEFVRTQKRLNPQEDKTEKDRSKVDDLRGSPMSVGNLEEIIDENHAIVSSSVGPEYYVNILSFVDKDQPGPGCAILMHNKVLSVVGLLQDDVDPMVSVMKVEKAPLESYADIGGLDPQIQEIKEAVELPLTHPELYEDIGIKPLKGVILYGEPGTGKTLLAKAVANSTSATFLRVVGSELIQKYLGDGPKLVRELFRVADELSPTIVFIDEIDAIGTKRYDAHSGGEREIQRTMLELLNQLDGFDSRGDVKVILATNRIESLDPALLRPGRIDRKIEFPLPDTKTRRRIFQIHTSRMTMADDVNLEEFVMTKDEFSGADIKAICTEAGLLALRERRMKVTHADFKKAKEKVMYKKKEGVPEGLYM

SEQ ID NO: 14667 - protein, 488 aa, Scytosiphon lomentaria
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAATTCGPLKAALDLWKDITFDYTSTDTPDFVEVATGSR

SEQ ID NO: 14668 - protein, 284 aa, Glycine max
MGNANGREDGSIPGPADPSVADPAARGTHAPDSRPPVRAFSSDSMANSPPQSPRRSRSPILFGPQVPLAPLQRGNGPPFLNQMWQNESHGIVNQLPEQGIPVMITWNYGGNNVAVEGSWDNWTSRKALQRSGKDHSILIVLPPGIYHYRFIVDGEERFTPELPNVADEMGHVCNLLDVNDYVPENPDGVSEFEAPPSPESSYGQAFPAEEDFAKEPMAVPSQLHLTVLGMEKSDIGSSSKPQHVVLNHVFIEKNLALKSVVALGLTHRFQSKYVTVVLYKPLKR

SEQ ID NO: 14669 - protein, 362 aa, Xylella fastidiosa 9a5c
MSISFDIARSLSTTSDEALSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVPSAPEASLYFRPFMIATEAYLGVRAAQHAAYYLIASPAGPYFAKGVAPVSIWLSTDCARAALGGTGAVKCGGNYAASLLPQQVAQAQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTYLKE

SEQ ID NO: 14670 - protein, 328 aa, Lycopersicon hirsutum
MAVNGASSSGLIVSFGEMLIDFVPTVSGVSLAEAPGFLKAPGGAPANVAIAVTRLGGRSAFVGKLGDDEFGHMLAGILKTNGVQADGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILADEARLKEVLRFSCACGAITTTKKGAIPALPTASEALTLLKGGA

SEQ ID NO: 14671 - protein, 758 aa, Streptococcus mutans UA159
MTQKTKQFSKYVQEKTGQNLEQLSNEAIYVQLLHFVKEAAKDMPKNTSKRKVYYISAEFLIGKLLSNNLINLGLYKTVKDELAAAGKSISQVEDVELEPSLGNGGLGRLASCFIDSMATLGINGEGVGLNYHCGLFKQVFRDNQQEAEPNYWIEDDSWLVPTAISYDVPFRDFTLKSKLDRIDILGYHKDSKNYLNLFDIDGLDYGLIKDGITFDKTEIKKNLTLFLYPDDSDKNGELLRIYQQYFMVSNAAQLLIDEALERGSNLHDLADYAYVQINDTHPSMVIPELIRLLNEKHGLDFYEAVDIVKNMIGYTNHTILAEALEKWPLEYLNEVVPHLVTIIEHLDRIVRSQYKDDAVQIIDRDDRVHMAHMDIHFSTSVNGVAALHTDILKNSELKPFYDIYPEKFNNKTNGITFRRWLEFANQDLAAYIKELIGEGYLEDATELEKLLAFADDKTVHEQLAKIKFNNKLALKRYLKENKGINLDENSIIDTQIKRFHEYKRQQMNALYVIYKYLEIKKGNLPKRKITVIFGGKAAPAYTIAQDIIHLILCLSELINNDPDVSPYLNVFLVENYNVTVAEKLIPATDISEQISLASKEASGTGNMKFMLNGALTLGTMDGANVEIAELVGSDNIYIFGKDSDTIIDLYDKGTYVSKDYYTNNAVIKEAVDFIVSKDVLALGKKERLERLYHELINKDWFMTLIDLKEYIAKKEEMLADYEDQNVWNKKVIQNIAKAGFFSSDRTIQQYDKDIWHSL

SEQ ID NO: 14672 - protein, 513 aa, Apium graveolens var. dulce
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 14673 - protein, 135 aa, Zea mays
PLATYAVADSIARCTDEAVDAKLRSFMNEHWSEAAFCAGFESAQQHFVNFMRIMERGESPIRLGDLPLELVIAMAYLPLYKECMNSNGRLLPQRLRGQLVEAASRLEDRQVERDSQSRELLAILEHHIPRFMIQT

SEQ ID NO: 14674 - protein, 251 aa, Magnetospirillum magnetotacticum
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 14675 - protein, 504 aa, Candida boidinii
MSNPPTYTTSQGCPVSDAFSTQRISGTKISIKTPVGPLLLQDFKFLDSLAHFDRERIPERVVHAKGAGAYGVFEVTEDISDICSAKFLDTVGKKTKIFTRFSTVGGEKGSSDSARDPRGFATKFYTEEGNLDLVYNNTPIFFIRDPTKFPHFIHTQKRNPATNCKDANMFWDYLTNNPESLHQIMYLFSNRGTPTSYRKMNGYSGHSYKWYNAKGEWVSSVHFISNQGVHNMTDEEAGDLSGKDPDFQTMDLYKAIEQGDYPSWECYVQTMTLEEAKKQPFSVYDLTKVWPHKDFPLRHFGKFTLNENAQNYFAEVEQAAFSPSHTVPGMEPSNDPVLQSRLFSYPDTHRHRLGVNYSQIPVNCPMRAVFAPQIRDGSMMVNGNLGGTPNYAGAYNCPVQYQAPIKASSKTPEEQYEGETLSYDWTEVNEYDFYQPGRFWEVLGKTKGEQEALVHNVANHVSGADEFIQDRVFAYFSKANPVIGDLIRKEVLKKSPRGASKNKF

SEQ ID NO: 14676 - protein, 335 aa, Pseudomonas aeruginosa
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHRGVVRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASKGSPVLGYNTQPLVSVDFNHDPRSSIFDANHTKVSGRLVKAMAWYDNEWGFSNRMLDSALALAAARD

SEQ ID NO: 14677 - protein, 362 aa, Aspergillus oryzae
MGVGVLEKLSRKTGVIVGDDVLRLFEHAQQNNYAIPAVNVTSSSTVVASLEAARDQNCPIVLQLSQGGAAYFAGKGVSNDGQQAPLPVVSLLPTTSVALLPPTVSLLSFTPTTAPRSSSLGSMASSTRMSATSSSTASPFFSSHMIDLSEEPVDYNIQTTAAYLKRAAPMKQWLEMEIGITGGEEDGVNNEDVDNNSLYTQPEDILAIHKALSPISPYFSIAAGFGNVHGVYKPGNVKLHPELLKKHQAYVKEKIGSNKDKPVFFVFHGGSGSSKEEYKEAISYGVVKVNVDTDMQFAYMSGIRDYILKKKDYLMTAVGNPEGEDKPNKKSFDPRVWVREGEKTMSQRVKVALEDFNTAGQL

SEQ ID NO: 14678 - protein, 422 aa, Populus deltoides
MPRFTSLILSSPLVFFLQVSLILATNAHSLSYIAKDSIIEIGIGREREEVMLKEESGGSGGVVNNWARVCDTCRAAACTVYCRADSAYLCAGCDARVHAANRVASRHERVRVCEACERAPAALLCKADAASLCTACDADIHSANPLARRHQRVPILPISGYLYGTQVGPAAGETEDQFMTQEGEETIGEEDEDEAASWLLLNPAKNSNNQNNNGFLFGGEVDEYLDIVEYNSCAENQYSDQYNQQHYSVPPKSCGGDSVVPIQYGEGKDHQQQQQQQYHNFQLGLEYEPAKAAYSYDGSVSQGVSMSSMDVGVVPESAMSEISISHQSASRGTIDLFSSPPIQMPSQLSPMEREARVLRYREKKKARKFEKTIRYASRKAYAETRPRIKGRFAKRTDVDVEVDQMFSSTLMAETAYGIVPSF

SEQ ID NO: 14679 - protein, 833 aa, Hypocrea jecorina
MADIDVEAILKKLTLAEKVDLLAGIDFWHTKALPKHGVPSLRFTDGPNGVRGTKFFNGVPAACFPCGTSLGSTFNQTLLEEAGKMMGKEAIAKSAHVILGPTINMQRSPLGGRGFESIGEDPFLAGLGAAALIRGIQSTGVQATIKHFLCNDQEDRRMMVQSIVTERALREIYALPFQIAVRDSQPGAFMTAYNGINGVSCSENPKYLDGMLRKEWGWDGLIMSDWYGTYSTTEAVVAGLDLEMPGPPRFRGETLKFNVSNGKPFIHVIDQRAREVLQFVKKCAASGVTENGPETTVNNTPETAALLRKVGNEGIVLLKNENNVLPLSKKKKTLIVGPNAKQATYHGGGSAALRAYYAVTPFDGLSKQLETPPSYTVGAYTTVPPILGEQCLTPDGAPGMRWRVFNEPPGTPNRQHIDELFFTKTDMHLVDYYHPKAADTWYADMEGTYTADEDCTYELGLVVCGTAKAYVDDQLVVDNATKQVPGDAFFGSATREETGRINLVKGNTYKFKIEFGSAPTYTLKGDTIVPGHGSLRVGGCKVIDDQAEIEKSVALAKEHDQVIICAGLNADWETEGADRASMKLPGVLDQLIADVAAANPNTVVVMQTGTPEEMPWLDATPAVIQAWYGGNETGNSIADVVFGDYNPSGKLSLSFPKRLQDNPAFLNFRTEAGRTLYGEDVYVGYRYYEFADKDVNFPFGHGLSYTTFAFSNLSVSHKDGKLSVSLSVKNTGSVPGAQVAQLYVKPLQAAKINRPVKELKGFAKVELQPGETKAVTIEEQEKYVAAYFDEERDQWCVEKGDYEVIVSDSSAAKDGVALRGKFTVGETYWWSGV

SEQ ID NO: 14680 - protein, 378 aa, Zea mays
MRRVALLLVAAVCALAAPAAAVVTDGLLPNGNFEDGPPKSALVNGTVVSGANAIPRWETSGFVEYIESGHKQGDMLLVVPQGAHAVRLGNEASIRQRLAVARGAYYAVTFSAARTCAQAERLNVSVSPEWGVLPMQTIYGSNGWDSYAWAFKAKMDAVTLVIHNPGVEEDPACGPLIDGVAIRALYPPALARRAGGNLLKNGGFEEGPYFLPGASWGVLVPPNIEDDHSPLPAWMIVSSKAVKYVDAAHFAVPQGARAVELVGGRESALVQEVRTVPGWTYRLAFAVGDSGDGCAGSMAAEAYAARATVKVPYQSRGTGGYKRAVLDFTAIANRTRVVFQSTFYHMKPDGTLCGPLVDDASLVGLRKKKPARRLMQLL

SEQ ID NO: 14681 - protein, 709 aa, Oryza sativa
MQYVTYNEDGNLEDVVNRPSSSRTTLTEYFKMNQVDPEARKLLYKEFPEHYRWIIGQNVWQKRKTQRGQVGRVVYAHPGEGERYNLRVLLNHVRGATSFEDLRTMSGERTNDVMTEIIEELNVLVDQDHLDIYTSLNDEQRAGFDEIIDNNASSASYMSTRAILSTKNDYVDKLNANMIDRFPVQAKVYHSFDSVDDDPHNSYPLDYLNSITPNGLPPHELIVKINCPVILLRNLDPNNGLCNGTRLMKRVSLAPRPALYRRRSQEGKTCLLRNLTQGVFEMSGRRSFFASKKPSRSSNPFDSDSDDGGREQRPARASSVPPPADQRGSLFGGGDGFSASSAAARSRYRNDFRDTGGVEAQSVQELEGYAAYKAEETTQRVQGCVRIAEEMRDTASKSLVTIHQQGQQITRTHMMTLDIDQDLSRSEKLLGDLGGIFSKKWKPKKNGEIRGPMLTRDDSFIRKGSHLEQRHKLGLSDHPPQSNARQFHSEPTSALQKVEMEKAKQDDGLSDLSNILTELKGMAVDMGTEIDRCFGSVPTHGPPTPNGRRNQRFLWKATAREAKVDGIMMWTLAPVLELERIAVDSGGDPDAIHHCAGLRFRDGLMFRALAEQWFSRNSVECRLVETSKFRGIRSVFVGIVNPVMKNGKSEGSKGLAAGVFPWCQQTYFDAADIVVKKKNKLINSGWLYARGAADLNDLYLVYVMRKQVY

SEQ ID NO: 14682 - protein, 256 aa, Pantoea oleae
  unsure (1)..(256): unsure at all Xaa locations
GAXGGIXZALALLLKTQLPAGSELSLYDIAPVTPGVAVDLSHIPTAVSIKGFSGEDATPALQGANVVLIXXGVARXPGMDRSDLFNVNAGIVRNLIQQVADTCPQALIGVITNPVNTTVAIAAEVLKKAGVYDKNKLFGVTTLDIIRANTFVAELKGKNPGELNVPVVGGHSGVTILPLLSQIQGVXFSEQEVSDLTKHIQNAGTEVVEAKAGGGXXTLSMGQAAARFGLSLVRALNGESNVVEXAYVEXDGQYAR

SEQ ID NO: 14683 - protein, 145 aa, Glycine max
  unsure (1)..(145): unsure at all Xaa locations
WSFPHRSLLQTNELYQLASVAFCLLVAWXDKLGLSLELDSFATGVMISTTDLGQHTLEQVEPIRNFFAALFLASIGMLIHVHFLWNHVDILLAVVILVIIIKTIVTISVVKGFGYNNKTSLLVGMSLAQIKEFAFVLLIVLQYSF

SEQ ID NO: 14684 - protein, 517 aa, Bradyrhizobium japonicum USDA 110
MIGSPLATSCEPGSLPLVRPSNAMELQQSQALNYGPAVSAVATDRIIETSIPSRLDALPWSGFHTRVVLALGITWILDGLEVTLAGALSGALKQSPSLQFSNLDLGIANSAYLAGAVLGALGFGWLTDRIGRKKLFFITLALYLSATAATALSWDIASYALFRFLTGAGIGGEYTAINSTIQELVPARYRGWTDLVINGSFWIGAAMGAVAAIVLLDPALIGPDLGWRLAYLIGASIGLVVLLMRMWIPESPRWLMIHGRPDQAHAIVDEIERSVIGHDQDASDRRFTRIRLKMRDHTPIREVMHTLFTVYRQRALVGLVLMGAQAFFYNAIFFTFALVLTDFYGISADHVGWYLLPFAAGNFLGPLLLGRLFDTLGRRAMIMFTYGASGLLLALSGYLFSIGALSAQGQTIAWMVIFFFASPAASAAYLTVSETFPLEVRALAIAVFYAVGTGIGGVIGPALFGALIDTGSRTSVFAGYLLGAFLMIAAAIVAWRYAVSAERKSLEQIARPLAFME

SEQ ID NO: 14685 - protein, 242 aa, Zea mays subsp. mexicana
SIRNNPVQNKLMNGEDPINNNHAQTAGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPPPPIRDSIVGYFSATAADDDASVGNGFLRLQAHQEPASMVVGGTLSATEMNRVAAATHCAGAMELIQTAMG

SEQ ID NO: 14686 - protein, 134 aa, Listonella anguillarum
MRSTGIADTVLVGPEPEFFLFDDVKYTNNMSGASFKIDDIEAAWNTGAEIEGGNKGHRPGVKGGYFPVAPVDSSQDIRSAMCLIMEEMGLVVEAHHHEVATAGQNEIATRFNTLTTKADEIQIYKYVVHNVAHA

SEQ ID NO: 14687 - protein, 138 aa, Triticum aestivum
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVEVEEVKKEYPDAYVRIIGFDNMRQVQCVSFIAFKPPGCEESGKA

SEQ ID NO: 14688 - protein, 117 aa, Zea mays
  unsure (1)..(117): unsure at all Xaa locations
MWQLYDPLRDKWITLPVMPSQIRNIXRFGVASVAGKLYVIGGGSDRVDPLTGDHDRIFASNEVWSYDPLHRVWSQRAPMLVARAMFXACCALDGKIIVAGSFTNCRKSISKAEIYDP

SEQ ID NO: 14689 - protein, 103 aa, Zea mays
  unsure (1)..(103): unsure at all Xaa locations
RQRVLSSSFSCFFASQTIVPLPHHLPRSEDGNEVFFRIKRSTQLKKLMNAYCDRQSVYMNAMGXLFXGXXLRSKQTPDELEMEDGDEIDAMLHQTGGSVPSTT

SEQ ID NO: 14690 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 14691 - protein, 214 aa, Zea mays
  unsure (1)..(214): unsure at all Xaa locations
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLXDYYKNKSIEHILI

SEQ ID NO: 14692 - protein, 359 aa, Agrobacterium rhizogenes
MFVRSDALSRIKPSATIVVSQKFRELKAEGRDVVRLNIGEPDFDTPDNIKTAAIDAINRGETKYTPVSGIPELRKAIASKFKRENGLEYSWEQTIVGTGGKQILFNAFMATLNPGDEVVIPAPYWVSYPEMVALCGGTPVFVSATQEHDFKLQPADLEKAITPKTKWFIFNSPSNPTGAAYTHAELKALTNVLMQHPHVWVLTDDMYEHLTYSDFKFVTPVEVEPSLYDRTLTMNGVSKAYAMTGWRRLCRRPAPAHQGHGHDPGAADLGCDVDRPVGGCRSAERHPGLHPGEQEDLRRPPRPRRLHAEPGQGHRLPGAGRRLLRLSVLRRPDRQDGAVGQGHRDGRGFRFRASGIGRR

SEQ ID NO: 14693 - protein, 472 aa, Prochlorococcus marinus str. MIT 9313
MSKAHFGLIGLGVMGENLVLNAERNGFSSVVYNRTYAKTEEFLKGLGSDKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVLAQWNATEELSSYLVEITEVCLRTKDPDDGSDLVEKIMDQAGQKGTGLWTVVSALELGASVPTIYASLNGRVMSSMKPQRITAEQILHGSAIKPFDLGSSADGMAPLMDAVVLSCMASYAQGMELLRIASAEYNYNLHLPSIAQIWKGGCIIRSRLLKRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 14694 - protein, 474 aa, Escherichia coli O157:H7 EDL933
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTVACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 14695 - protein, 458 aa, Ptilophora scalarimosa
PDYVVKETDVLALFRITPQPGVDAVEASAAVAGESSTATWTVVWTDLLTACDLYRAKAYKVDPVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTSATMEDMYDRAEFAKQLGTVIIMIDLVIGYTAIQTMAVWARKNDMILHLHRAGNSTYSRQKSHGMNFRVICKWMRMAGVDHIHAGTVVGKLEGDPLMIRGFYNTLLLPHLDVNLPQGLFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 14696 - protein, 448 aa, ASPERGILLUS NIDULANS FGSC A4
MTFSVFDNYQNTINGVQTSTAEKRHGINPATGEPNPDVPVATAEDVDKAVAAAEEAFKTWSEVPFVERQKALLAFADAIEKHAEDFSKLLVQEQGKPDSAEKKIVVRHTPIGVAAGIIPWNFPLALAVIKLAPALLTGNVIIIKPSPFTPYCGLKLAELAQQFFPPGVVQALSGDDRLGPWLTAHPGIGKISFTGSSATGKKVMESASKTLKRVTLELCRGGKDAAIVCKNVDVKSVAPQVVSKGFLNSGQICLAVKRIYVHESIYEEFRDAAVAYAKTVQVGPGTQEGVFMGPLQNSMQYEKVKGFFADLTKEQLSLTHTDGKAFDDKPGYFIKPTIIDRPAEDSRIATEEQFGPIVPLLTWNDESEVIARANNTRMGLGASVWSSDLDEAARIAAKLQAGSVWVNTHFESDPRAPFGGHKESGIGTENGLHGLRQWCNLQTLYLKK

SEQ ID NO: 14697 - protein, 543 aa, Zea mays
MAMAGGQNMQVLSALDGAKTQRYHFTAIVVAGMGFFTDAYDLFCISLVTKLIGRIYYTVDGSPRPGSLPPHVSAAVNGVAFVGTLSGQLFFGWLGDRVGRKSVYGMTLLTMVVCSVASGLSFGRSPACVMATLCFFRFWLGFGIGGDYPLSATIMSEYANKRTRGAFVAAVFAMQGFGILAGGAVAIGVTALFRSRFPAPPYDVDPAASTPAEADLVWRIILMFGAVPAALTFYSRMKMPETARYTALVARNAERAAADMSRVLQVDIGNKEQPGAEEEATTGTEARLRGEQEEATTGPPFGLFSREFAHRHGLHLVGTASTWLLLDIAYYSQNLFQKDIFSAVGWIPAAETISALDELFHIARAQTLIALCGTVPGYWFTVAFIDIVGRFAIQAVGFLMMTAFMLGLAVPYRQWTRPGNQTGFVVMYALTFFFANFGPNATTFIVPAEIYPARLRATCHGISAASGKVGAIIGSFGFLYLAQSQDPAKTAHGYAPGIGVRNSLLLLAGCSFLGFLLTFLVPEPKGKSLEEMSRETEPGAAEP

SEQ ID NO: 14698 - protein, 358 aa, ASPERGILLUS NIDULANS FGSC A4
MFAARQSFGFLQKRAFSASASQASKVAVLGASGGIGQPLSLLLKLNPRVSELALYDIRGGPGVAADISHINTNSTVKGYEPTESGLADALKGSEIVLIPAGVPRKPGMTRDGKEDDCENLRIGTDLLMTDLFNTNASIVRDLAKAAAKASPEANILVISNPVNSTVPIVSEVFKAAGVYNPKRLFGVTTLDVVRASRFISQVQGTDPSKEAVPVVGGHSGVTIVPLLSQSNHPNIDGKTRDELVHRIQFGGDEVVKAKDGAGSATLSMAMAGARFAESLLRAAQGEKGVVEPTFVESPLYKDQGVNFFASKVELGPNGAEKINPVGEVNEFEQKLLEACLVDLKKNIQKGIDFVKANP

SEQ ID NO: 14699 - protein, 302 aa, Glycine max
  unsure (1)..(302): unsure at all Xaa locations
MGVVTVGELKPSISGKRTFRPSSSIRHATEWPISDVSSDLTIEVGASTFALHKFPLVSRSGRIRKLLLDAKDSKVLRISLPNVPGGAEAFELASKXCYGINVEFTLSIVALLRCTAHFLEMTEEGSRKNLEARAEAYLRDTVLPNISSTVHVLHCCEALRPISEQINLVNKLINAIANNACKEQLTTGLLKLDHTFPSKTTPTMEPETPSDWWGKSFNVLSLEFFQRVVSVVKSKGLKQDMISKILMNYAHGSLQGIGVRDPQVVKGSLHDLEFQKKQRVVDETIVGLLPTYSRKKPGSNGI

SEQ ID NO: 14700 - protein, 121 aa, Triticum aestivum
  unsure (1)..(121): unsure at all Xaa locations
YLCKGVYKAANNGNSIIAPAVVGIDPTGQTELDNCMVQNLDGTKNEWGRCKQXLAANAILTVSLAAGKAGASVKNIPLYQHIANLAGNKQLVLPVPAFNVINGGSHAGNKLAMQEFMILPT

SEQ ID NO: 14701 - protein, 97 aa, Glycine max
  unsure (1)..(97): unsure at all Xaa locations
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 14702 - protein, 588 aa, Oryza sativa (japonica cultivar-group)
MASPRPHLTAPGTVATLPTPPRAALPSSYLRFVSSTTTALRHDATNTTVGGTPFLRDNHLADAMEEDQSATYSVDDALLSSGFGRYQILILSYAGVGLIAEAMEMMLLSFVGPSVQLEWKLTSHQESMITSIVFVGMLIGAYTWGVVSDNYGRRQLSNGSQKMVCELVSMHSLFQLIVLAIVIKTGPDRRRGFLFTAIVTSGAGFLSAFAPNYVSLISLRFLVGIGLGGGPVLASWFLEFVPAPTRGTWMVVFSAFWTVGTIFEASLAWTVMPKFGWRWLLALSAVPSFVLLLFYVITPESPRFLCMKGRVTEAMDVLEKMARLNNVQLPSGRLVSDKNIELDELSTSESTTLLADAEEDDTIIEDKVSSFGGLSVAKLLSPKLIRATLLLWMTFFGNAFSYYGIVLLTSELSNGNRICAKEEVESIHSNDASLYKNVFISSFAEIPGSFLSAMIVDRIGRKLSMASMLFTSCVFLFPLIFSRTDILTRVSLFGARLCISASFTIVYIYAPEIYPTSVRTTGIGVASSVGRIGGILCPLVAVALVHSCQQTTAILLFELVIFLSGLAVSFFPFETKGCRLNDTEVVMN

SEQ ID NO: 14703 - protein, 355 aa, Triticum aestivum
  unsure (1)..(355): unsure at all Xaa locations
GQTYERSCIQKWLDSGHKTCPKMQLALTHTSLTPNFVLKSLIAQWCEANGIELPKNKANSHDKKAVKSSDYDNAGLVSLMNRLRGGNQDEQRAAAGEIRLLAKRNVNNRICIAEAGAIPLLVNLLSSSDPRTQEHAVTALLNLSIHENNKASIVDSNAIPKIVEVLKTGSMEARENAAATLFSLSVVDENKVTIGAAGAIPPLINLLCDGSPRGKKDAATAIFNLCIYQGNKVRAVKAGIITHLMNFLVDPXGGMIDEALTLLSILAGNQEGKSVITQSEPMPPLVEVIKTGSPRNRENAAAILWALCSADAEQTMAAKAAGGEDALKELSETGTDRAKRKASSLLELMRQSEEA

SEQ ID NO: 14704 - protein, 250 aa, Oryza sativa; identical to SEQ ID NO: 1253

SEQ ID NO: 14705 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 14706 - protein, 266 aa, Ralstonia metallidurans
MAGASGPARRSSRLRGPDRRKIPPIPPSARPNIMSSPTFRIAPSILSADFARLGEEVRRVTEAGADWIHFDVMDNHYVPNLTVGPLVCEAIRPHVTAPIDVHLMVRPVDRIIPDFARAGANIITFHPEASDHIDRSLALIRDNGCQAGLVFNPATPLHYLDHVMDRLDVILLMSVNPGFGGQSFIPETLNKLRAVRQRIDAYTARTGRRILLEVDGGVKVDNIAEIAAAGADTFVAGSAVFGKPDADGGYKGVIGALRAELATVGK

SEQ ID NO: 14707 - protein, 359 aa, Nostoc sp. PCC 7120
MALVPLRLLLDHAAENGYGIPAFNVNNLEQIQAILKAAAETDSPVILQASRGARNYAGENFLRHLILAAVETYPEIPIVMHQDHGNAPSTCYSAIKNNFTSVMMDGSLEADAKTPASFEYNVNVTREVVNVAHALGVSVEGELGCLGSLETGAGEAEDGHGFEGTLDHSQLLTDPDEAVNFVEATQVDALAVAIGTSHGAYKFTRKPTGEILAISRIEEIHRRLPNTHLVMHGSSSVPEDLIALINEYGGAIPETYGVPVEEIQKGIKSGVRKVNIDTDNRLAITAAVREALAKNPKEFDPRHFLKPSITYMQKVCAERYVQFGTAGNASKIKQVSLETFAAKYAKGELNAISKAAAKV

SEQ ID NO: 14708 - protein, 311 aa, Oryza sativa (japonica cultivar-group)
MAKNTCKLCYRRFGNPRALAGHMRSHSVAASRSQISSTSSASTSVAVGDDDGGGDAKRPIQGYVLREKPKRRVRLAESDFSDRESETEYYSSPPHGKRANTGSGDVEQVSSVSDATSEEDVALSLMMLSRDTWPATPPPPPPYRLRGAGYDDGSDGGDAPPAPAAAAAQKRTRFQCPACKKVFRSYQALGGHRASHMRGGRGGCCAPPPNPPPSPATPLQPLPECDGGEEEGAKPHPHECPYCFRVFASGQALGGHKRSQLCSAAAAAASGDDIPAMIKSNGFIDLNLPAPFDDVELSAVSDPFLSSKPGS

SEQ ID NO: 14709 - protein, 521 aa, Arabidopsis thaliana
MADQQLGVLKALDVAKTQLYHFTAIVIAGMGFFTDAYDLFCVSLVTKLLGRLYYFNPTSAKPGSLPPHVAAAVNGVALCGTLAGQLFFGWLGDKLGRKKVYGITLIMMILCSVASGLSLGNSAKGVMTTLCFFRFWLGFGIGGDYPLSATIMSEYANKKTRGAFIAAVFAMQGVRILAGGFVALAVSSIFDKKFPSPTYEQDRFLSTPPQADYIWRIIVMFGALPAALTYYWRMKMPETARYTALVAKNIKQATADMSKVLQTDLELEERVEDDVKDPKKNYGLFSKEFLRRHGLHLLGTTSTWFLLDIAFYSQNLFQKDIFSAIGWIPKAATMNAIHEVFKIARAQTLIALCSTVPGYWFTVAFIDIIGRFAIQLMGFFMMTVFMFAIAFPYNHWILPDNRIGFVVMYSLTFFFANFGPNATTFIVPAEIFPARLRSTCHGISAATGKAGAIVGAFGFLYAAQPQDKTKTDAGYPPGIGVKNSLIMLGVINFVGMLFTFLVPEPKGKSLEELSGEAEVDK

SEQ ID NO: 14710 - protein, 442 aa, Triticum aestivum
  unsure (1)..(442): unsure at all Xaa locations
MVPELKVPLREGRGARPSEPPAMAPESKVAPLVGGGPRPSRAPGGPASCPSAAAACSACLTRMLLRADWRAHLREQETAQDGTRECERRLNRGDGGNYTYGDLGERGFGPVGRYFTEAIIIIGGFDRGGAXSHLVLSSSASPSSVCPRPPRRPRTFLACSCCRRRGRASPRVRSPLRVGAPFSILADACTVLAVAAVVKEDVQLLAKRGRPFAGRSAFAGLWGVPFACGVAVFCFEGFCLTLALEASMSNRGRFRPVLFQAIVGVTIVYISFGVCGYLAYGDDTRDIVTLNLPDNWSTAAVKVVLCVGLALTFAVMMYPIHEIVEARLLAPGGWVRRRCGGVVQRAALHLSRVAVVAALAAIACFVPAFGDFVAFVGSTVCALLSFVLPALFHLSFVGPTASPWARAVDYFLLLAGLVFAGHGMYTVLAPIYKLKLDITFVK

SEQ ID NO: 14711 - protein, 157 aa, Bidens pilosa
QFYKYKRPRQWLTSGGLGAMGLGLPAAIGATIANPNAIVVDIDGDGSFLMNVQELATIRAENLPVKIMLLNNQHLGMVVQREGRFYESNRGHTYLGDPSRKEEIFPNMLGFAYACGIPAARVTKEEELREAIKKMLDTPGPYLLDVIVPHQEHVFAN

SEQ ID NO: 14712 - protein, 485 aa, Achromobacter xylosoxidans
MKEIKHFINGAFVGSASGKLFDNVSPANGQVIGRVHEAGRAEVDAAVKAARAALKGPWGKMTVAERAEILHRVADGITARFDEFLEAECLDTGKPKSLASHIDIPRGAANFKVFADLLKNVANETFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVK

SEQ ID NO: 14713 - protein, 383 aa, Oryza sativa; identical to SEQ ID NO: 3807

SEQ ID NO: 14714 - protein, 424 aa, Phaseolus vulgaris
MGNSEEGKSVKTGSPSSPATTTNQTNQPNFHVYPDWAAMQYYGPRVNIPPYFNSAVASGHAPHPYMWGPPQPMMPPYGPPYAAFYSPGGVYTHPAVAIGPHSHGQGVPSPPAAGTPSSVDSPTKLSGNTDQGLMKKLKGFDGLAMSIGNCNAESAELGAENRLSQSVDTEGSSDGSDGNTAGANQTKMKRSREETSTTDGEGKTETQDGPVSKETTSSKMVMSATPASVAGKLVGPVISSGMTTALELRKPLTVHSKENPTSAPQPCAAVPPEAWLQNERELKRERRKQSNRESARRSRLRKQAETEELARKVEMLTAENVSLKSEITQLTEGSEQMRMENSALREKLRNTQLGQREEIILDSIDSKRSTPVSTENLLSRVNNSSSNDRSAENESDFCENKPNSGAKLHQLLDTNPRADAVAAG

SEQ ID NO: 14715 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 14716 - protein, 310 aa, Pseudomonas aeruginosa PAO1
MHSLRFFSNAEVAERLAYPQLIEALRIGLAKPCSAPLRNCHALPAQASLLQMPVWQAGAGIGVKLVTVFPGNGARGLPAVAAVFALFDGEDGRPLALLEASELTARRTACSSALAADYLARDDARRLLVVGCGTLAAHMVRAHACVRDYRHIDIWGRDPAKAAALAARLREEGYPARAADGLRAAVEAADCVSCVTTSREALVRGAWLKPGVHLDLVGAFLPSMRETDVLAVARARVVVDTRAGALEEAGDLLQAIAEGAIGREAISTELRDLLSGAGRRGDPGEITLFKSVGYALEDLVAARRVVDNAA

SEQ ID NO: 14717 - protein, 482 aa, Bradyrhizobium japonicum USDA 110
MDVNLLISGRDQAASTGKVFERRNPLSQEVASRAAAATVSDADAAVAAASAALAAWSALGPNARRALLLKAADALEAKRDAFIRIMMAEIGTTEVWSAFNVKLATGMLREAASLTTQVAGEVIPSDKPGCLAMAVRQPAGVCLGIAPWNAPIILGVRAVATPLACGNTVVLKASEICPGTHRLIGEVFRDAGFPPGVVNVLTNAPADAPAVVERLIANPAVRRINFTGSTRVGRVIAELAGRHLKPVLLELGGKAPLVVLDDADLDAAVAAVAFGAFINQGQVCMSTERVIVDESVADQFVAKLAKKAGALPAGDPRSGPVVIGSMIDEAPARHVVALIDDAIGRGAVKLAGGERAGTVVPATVLDRVVPGMRIYSEESFGPVVSVIRARGVDDAVRLANDTEYGLSAAVFGRDVARALTVAQRIESGICHVNGPTVHDEAQMPFGGVKGSGYGRFGGQAGIAEFTDLRWITIETQPQHYPF

SEQ ID NO: 14718 - protein, 508 aa, Oryza sativa (japonica cultivar-group)
MGLQGNKATHDFLSLYAAAATATDYSPLPRHPDSKPSAPAPPPAQDFFLKTHDFLPQVEKRADQTPPPPPPPPPHAAVTAEKQLLHQHALAAAGAFTINHAVAAAATAVKQEPPFAPWCQPVAAVDPRGHQWSLPFAARAVAVASSRPQQQQQQPPPPERKGGGGFMDAGSRSSGGAGFDDDDGHAARREVSSSLKELTVRVEGKGGSCSGSAGTDQMPNTPRSKHSATEQRRRSKINDRFQLLRDLLPHNDQKRDKASFLLEVIEYIRFLQEKVQKYEVSYPEWNQENAKVVPWTNIYFRSSWKNAQNKGQVPADHSPDPPELLKNGSPYMFPFTGNSDNNNAVETAAASGAQDQAETDPMSRVSYRSVDTPSPNNVADKVTSQPHAQLVRPSPAENHTVNCDKLNNSDLAIDEGTISLSSQYSQELLNKLNHALENSGIDLSQASISVQINLGKRAMKRSTPAATSTSKELTDPASNSQAMGRQLRLGDGAEEHRQASKRHKSDNS

SEQ ID NO: 14719 - protein, 511 aa, Zea mays
  unsure (1)..(511): unsure at all Xaa locations
MMASQAMVPLRQLFVDGEWRPLALGRRLPVVNPTTEAHIGEIPAGTTEDVDPAVXASSRAALKRNXRGRDWARAPGAVRARDLRAIVAKGIERKQELAKLEALDCGKXYDEAAWDMDDVAGCFEYFADQAEALDKRQNSPVSLPMETFKCHLRREPIGVVGLITPWNYPLLMATWKXVAPALAAGCTAVLKPSELASVTCLELADICKEVGLPSGVLNIVTGLGPDAGAPLSAHPDVDKVAFTGSIETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAXVISGDRERCQRLSEEIDAGCIWVNCSQPCFCQAPWGGNKRSGFGRELGEGGIDNYLSVKQVTEYISDEXPWGWYQSPSKL

SEQ ID NO: 14720 - protein, 413 aa, Arabidopsis thaliana
MAHYINIYGKRLFDIGLYLKTSVDLILQQQHVLMSQQKFTDISLCHREAPNPVKLEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKKEVAMSPKNKKVTYSYVLSAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVVNDLVYVTDNAYSSRQILVMKKAILGNLEWYLTIPTQYVFLFCFIKASISDPEVSTFLLKVQFFCYYNVDWFSFVVQFLDLIVPKLRDNYSTHKMF

SEQ ID NO: 14721 - protein, 620 aa, Neurospora crassa
MSDKSITSLTSQDRREAEAQVVAEHLPAGYTAEFDPEHNSITTQHGSEATTHSQANKTVSAGSAEGSSSTRTRSTTPTPNEVEAGGAASSLKLQGGDIHRNIFKIDASAKLQQLHRRANTFHTPREFEQNTEVPMTVSDQLAPGGARRAFLHRKHGGGGNDFLAARMPITRNFVEFLDLYGSFAGEDLADSDEEAVEEEEEEEETRIGETTALLRHRRPSMRVPKARPHTAGTTKTFFTLIKAFVGTGIMFLPKAFANGGLLFSSLAMVIVSAVTMIAFHLLLQCTHHHGGGYGEIGAAIAGERMRTLILASITISQLGFVCAGIVFVAENLTSFLTAVTPGSQAPLSSVALIAIQVVLLVPLAWIRNISKLGPAALLADACILIGVSYIYQFDIRALAANGIHKSVVLFNPERYTLMIGSAIFTFEGIGLILPIQSSMAQPQRFEWLLAIVMVIITLVFTSVGALSYATFGTETQIEIINNFPQDSKLVNAVQFLYSVAVLVGTPVQLFPALRIIEGKVFGHRSGKRSQRTKWIKNMFRLGLLVLCAVVAVLGTGNLDKFVALIGSTACVPLVYVYPAYLHYKGVATARWAKVGDVAMMVLGVVCMVYTTAVTIYYSFM

SEQ ID NO: 14722 - protein, 135 aa, Haemophilus influenzae
EDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKDLNVSRTSVPVIGGHSGVTILPLLSQVQYAKWN

SEQ ID NO: 14723 - protein, 159 aa, Frankia sp. FE37
ITKEEYSRDPRNTAKKAEAYLRGTGFADTAYFGPEAEFYIFDDVRYDYNPYGSMHAVDSVEAAWNTARKEEGGNLGYKPRFKGGYFPVPPTDHFTDLRSEMVRALFRAGITVEMQHHEVGTAGQAEIDIRYSTLLRTADNLMLYKYIIRNVALSRGKTV

SEQ ID NO: 14724 - protein, 502 aa, Pseudomonas fluorescens
MTRSLTMNSSLPAIDGLRLPHQMLIGGQWVNAQSDKTLNVYNPATGDTLTDVPDGDVEDVNAAVESAAATLQSDAWRRMPPSARERILLRLADLLEAHGDELARLETLNNGKLLIYSKMMEVGASAQWLRYMAGWATKLTGSTLDLSLPLPPDVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 14725 - protein, 450 aa, Ipomoea batatas
LTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECSVEHSIIGERSRLDCGVELKDTLMMGADTYETESEIASLLADGKVPIGVGENTKIRNAIIDKNVRIGKDVVIMNKDGVQDSDRPDEGFYIRSGITIIMEKATIPDGTVI

SEQ ID NO: 14726 - protein, 336 aa, Schizosaccharomyces pombe
MAIPKVGINGFGRIGRIVLRNALVAKTIQVVAINDPFIDLEYMAYMFKYDSTHGRFDGSVEIKDGKLVIDGNAIDVHNERDPADIKWSTSGADYVIESTGVFTTQETASAHLKGGAKRVIISAPSKDAPMYVVGVNEEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDAVVSTDFCGDNHSSIFDASAGIQLSPQFVKLVSWYDNEWGYSRRVVDLVAYTAAKDN

SEQ ID NO: 14727 - protein, 368 aa, Buchnera aphidicola str. APS (Acyrthosiphon pisum)
MTDNVLKLSRKNIKKLIPYQSARRIGGEHGNILLNANESPVSIFFKLKKKPFNRYPECQPSKLISSYAHYVNLSCNQILATRGADEGIELLIKAFCEPGKDAIIYCPPTYDMYRINATIAGVEIKEIPTIKNTWQLDLLNIKLNLSRVKLIYICNPNNPTGNIFFKKDLIFLLNITLGQALVVIDEAYIEFSPEESMTNYLKDYPNLVVLRTLSKAFALAGIRCGFTLAKKEIIQTLSKVISPYPISIPVSDIAIRSLEKDYVQLMKNRVLDSNNNRIWLINQLKNITCVETVFESNANYVLVKFSMFEKVFETLWNKGIILRNQNEKTNLKKCIRISMGTRSESLRLIKELKIFSKKNMCQGEMSEK

SEQ ID NO: 14728 - protein, 537 aa, Arabidopsis thaliana
MFLLLKPLLSLHDLSLNLLSVMFHGETLKASVDGVGINMSTMWRETRNVFIVPLFKCIVVMCLIISLLVFVESVYMNLVVLYVKLFNRKPEKVYKWEAMQEDMELGHQNYPMVLVQIPMYNEREVFELSIGAACRLTWPSDRLIVQVLDDSTDPAIMELVSMECTKWASKDININYERRENRNGYKAGALKHGMRHSYVKQCQYLAIFDADFQPEPDYLQRAIPFLIHNPEVALVQARWRFVNANTCLMTRMQEMSLNYHFMAEQQSGSTRHAFFGFNGTAGVWRMVAMEEAGGWKDRTTVEDMDLAVRVGLLGWKFIFVNDLEVKSELPSQFKAFRFQQHRWSCGPANLIRKMTMEIIHNKRVKIWKKFYVIYSFFFLRKIVVHFFTYFFYCVILPTSVFLPEVNIPNWSTIYVPSVITLLSAIATPRSFYLVIFWVLFENVMAMHRTKGTLIGLFEGGRVNEWVVTEKLGDTLNTKLLPQNGRLPKRVNLKEMMMGIYILCCACYDFAFGNAFLYLYLFMQATAFLISGVGFVGT

SEQ ID NO: 14729 - protein, 197 aa, Leucophanes glaucum
GGAKKVVISAPSKDAPMFVMGVNEDKYTNEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDAIKAALKEASQGKLKGILGYTEDEVVSSDFITDSRSSIVDAKAGIALSDTFVKLV

SEQ ID NO: 14730 - protein, 623 aa, Oryza sativa
  unsure (1)..(623): unsure at all Xaa locations
MLRRCVRDLYPLRPLRRIPRPISSEVPSPAFLRPRSKSTKASQQSSTQNTVPGPQGEPSQSGSNVPKVLLGTLMVGAAAMAAYQAGYIDDQFKDIIFPSTMKEKNIRKIYDDLKAPSEQKVDEKQVVSDPNVDIVQNSNNEAHPQKDLPTEGMGPPEIPTTDEQTVSSEEKEKETLAQGTPQIPDEHGAAAKPLSQDIPVIDINPSVDDKATGEVLPEQTDKTTTSVSPVQSSLATAGPSHHVHTDTDGPKDPSSAGAVEHKSLAETYLLQDPDNSKDMGAKESKHDGVISTGTSDDGKIVLDIIEAIHAAERKQADADAYMYSEEKRKLKEKYEKELKXPGLGSSCMLKXSNSGKELKKEKLKSAAVIKELQENAEQKLRDELQQKDEETSQQVEKVRELAKAELAAALAKERASQIEQIAEANLNIDALCMAFYARSEETRQSHSVHKLALGTLALEDALSTGSPIRTEVDQLRKSLEGIDKDSLLELALSSIPEDVLEYGSDTPMDLKQKFNSLKETVRHFSLIPAGGGGMLTHAVAHVASSIKIKEDQSGDGIESLLNRVENLIIHGDLSAAAEALERGLQGSEAAEIASEWVKQARKRAIAEQTLTLLHSYASSITFS

SEQ ID NO: 14731 - protein, 340 aa, Thermosynechococcus elongatus BP-1
MTLRVGINGFGRIGRLVLRAGLACDNLQFVGINDLVPADNLAYLFKYDSTHGMYPGTVKATAEGIEIDGQFIPCTAVRNPAELPWGAVGADYVVESTGLFTSYEGAAQHLQAGAKRVVISAPTKDADKVKTIVVGVNHDTFDPSSDRIVSNASCTTNCLAPVAKVLHASFGLAEGLMTTVHAVTATQPTVDGPSKKDWRGGRGAGQNIIPASTGAAKAVTLVLPELKGKLTGMAFRVPTPDVSVVDLTFKTEKATTYGDICAAMKAAAEGELKGILGYTEEAVVSSDFIGDGRSSIFDATAGIQLNANFFKVVAWYDNEWGYSCRVVDLLKLMAAKEGLL

SEQ ID NO: 14732 - protein, 105 aa, Zea mays
MDWSTRFRIRNPSPAASHFAGHRRSQADRVFLRTMASAAPVEEPTAAAEAKGRLTGDSFIRRHLRTLAPYQPILPFEVLSARLGRRPEDIIKLDANENPYGPPPE

SEQ ID NO: 14733 - protein, 480 aa, Pseudophycodrys phyllophora
QAIKNERYESGVIPYAKMGYWDPDYVIKETDILALFRVSPQPGVDPVEASAAVAGESSTATWTVVWTDLLTACDLYRAKAYKVDAVPNTTDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMEEMYERAEFAKALGTVIIMIDLVIGYTAIQSMAIWSRRNDMILHLHRAGNSTYSRQKIHGMNFRVICKWMRMAGVDHIHAGTVVGKLEGDPLMIKGFYDTLLLPHLDINLPLGIFFTQDWAALRKVTPVASGGIHCGQMHQLLDYLGDDVVLQFGGGTIGHPDGIQAGATANRVALESMVIARNEGRDFVTEGPQILRDAAKTCGPLQTALDLWKDITFNYTSTDTPDFVETPTASV

SEQ ID NO: 14734 - protein, 161 aa, Oenococcus oeni MCW
MNGRSFEIAVLPGDYIGPEIMRAGLAVLAVVSKNKNFDYKIKELPFGGAAIDKDGDPLPANTLKECQDSDAILLAAIGGPKWDQASKRPEAGLLEIRKALNLFANIRPTAISPAMQKYSPLKQIKKIDFLIVRELTSGIYFGKPREESEQAALDTMRYSAT

SEQ ID NO: 14735 - protein, 525 aa, Triticum aestivum
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIVVSSAFRHAFPAPPFYIDAAASIGPEADYVWRIIVMFGTIPAALTYYWRMKMPETARYTALIAGNTKQATSDMSKVLNKEISEEDVQGERATGDTWGLFSRQFLKRHGVHLLATTSTWFLLDVAFYSQNLFQKDIFSKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDAIAPTGV

SEQ ID NO: 14736 - protein, 243 aa, Zea mays
  unsure (1)..(243): unsure at all Xaa locations
MGQGGEVKAAPAVRVLVVDDSPVDRKVVELLLRNHNHQGGAAPFHVTAVDSGKKAMEHLRLMEQGGQXLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 14737 - protein, 488 aa, Vaucheria walzii
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKQLGTIIVMIDLVIGYTAIQSMAIWARKADMILHLHRAGNSTYARQKNHGINFRVICKWMRMAGVDHIHAGTVVGKLEGDPLMVKGFYNTLLDTKLEINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 14738 - protein, 238 aa, Glycine max
CPYGCEKTTEGYPKNEKLFLVCFSFAEGPLAWALIVWRCSLVFSSVDKIVSVLIHLLPELVFFTIRWWNPATFEAMRPAGMAGRSTWPYIEDKSYLWMWLFLVPLAVYILWQVLYFLIVNVLRQQRFLRDPEAMTSYRELSKKAQKANNIWWRLSGLLGDQNRLLMYIVLQGIFTVATTALTVPIFLSYELSVVFQLLKISASVWNGGSFLIDVMPRQVILKEKKKSEMQPVQNKKDQ

SEQ ID NO: 14739 - protein, 852 aa, Bacteroides thetaiotaomicron VPI-5482
MEYSSYNVNTPQWREITVGSHLPAELRKLAEIAHNLWWTWNDDAKKLYCDLDSELWKEVEQNPVLFLERINYEKLVALAHDENFVYKMDAVYSAFKKYVDVEPDHQRPSIAYFSMEYGLDEVLKIYSGGLGMLAGDYLKEASDSNVDLCAIGLLYRYGYFDQSLSMDGQQTVNYKAQNFGQLPIEKVMQPDGKQLVIHVPYADSFVVHANVWKASVGRIPLYLLDTDNELNSEFDRPITHHLYGGDWENRLKQEILLGIGGMITLRALGITKDVYHCNEGHAALINIQRLCDYINGGLNFGQAMELVRASSLYTVHTPVPAGHDYFDEGLFNKYMKGYPGKLGITWDNLMDLGRHNPGDKEERFCMSVFACKTCQEVNGVSKLHKSVSQQMFAPIWKGYFPEENHVGYVTNGVHLPTWCAAEWKKLFKDNFDENFFCDQSNQKIWEAVYGIPDEEIWNTRLKQKAKLLDYIKSKCSKDWLRTQIDPALSVSIFERFNPDALLIGFGRRFATYKRAHLLFTDIDRLARIVNNPKYPVQFIFAGKAHPNDGAGQGLIKQIVEISRRPEFLGKIIFLENYDMDLARHLISGVDIWMNTPTRLAEASGTSGEKALMNGVLNFSVLDGWWYEGYRKDAGWALTDKRTYQNEQYQNQLDAEAIYYLLEHDILPLYYEHGGKNYSEDWVKYIKNSIAQIAPHFTMKRQLDDYYDRFYNKLSEHFHILAADNFAKAKMMADWKANVRSRWDAIEIKSIEAGNGLNATVEAGKEYEVTVVVDEKGLDDAIGIESVIIRREDGQDHIYEVIPLLPVSKNGNLYTFKATSGIFNAGSFKQAFRMYPKNALLPHRQDFCYVRWF

SEQ ID NO: 14740 - protein, 334 aa, Thermosynechococcus elongatus BP-1
MSSKPDRVVLIGVAGDSGCGKSTFLRRLADLFGEDFMTVICLDDYHSLDRKQRKEMGITALDPRANNFDLMYEQIKALKNGESIMKPIYNHETGTIDPPEKVDPNHVIVIEGLHPLYDERVRSLIDFSVYLDISDDVKIAWKIKRDMAERGHSYEDVIASINARRPDFMAYIDPQKQYADVVLQILPSQLAKEEKVGNILRVRMLQREGIPGFEPVYLFDEGSTITWIPCGRKLTCSYPGIRLSYGPDEYYGHPVSVLEVDGRFEKLDELIYIESHLSNTSTKHYGEVTELLLKHRDYPGSDNGSGLFQVLTGLKMRATYERLTSRDAATVTNR

SEQ ID NO: 14741 - protein, 166 aa, Triticum aestivum
MGGGHKESGCDTNSRGLGGYYPSAYSSPPIAYPAYPPPQAGHGCPPAYYPPQPQGYGHGYPSAGAYGYPPSSYPHHQGGYHGHGGSLLVAGGAAAAAAYGAHHMSHGHHGHGGYYHRPAGYHHHYGGKFKKHGRYGYGHGGKFKHGKHMRLFVGKHGLFGGKHKWK

SEQ ID NO: 14742 - protein, 233 aa, Zea mays
MTVLDAESRFHVLAVDDSIIDRKLIEMLLKSSSRVDPRVRPRVRALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHEPEEAAADRNGVNKRKAAAMEEGLTVVVTAPESTKPRRLSTSSLTVET

SEQ ID NO: 14743 - protein, 534 aa, Oryza sativa
MGEDGGVNSSSNSPAAAVGLVLVVAICTYLAVVATRKQKRRRRRRPPVVGTAFHQLYHVRRVHDYHTALSREHMTFRLLVPAGREQIYTCDPAVVEHILRTNFANYGKAGAVHVCGFVAALTRMVSVKNTKGSFNHGNMSDLFGDGIFAVDGDKWKQQRKIASYDFTTRALRDFSGDVFKRNAAKLAGVVSSHAASNQSMDFQGFLMRATMDSIFTIAFGQDLNTLDGSGEGRRFAAAFDDASEFTMLRYLNPFWKLSRLLNVGAEAMLKERIKVVDGFVYKLIRDRSDELSNTKAHDTDILTRFIQATTSDSGTVDYKYLRDIILNIVIAGKDTTAGSLAWFLYMMCKHPEVQEKICHEAMEATNAGEAASIDEFSQSLTDEALNKMHYLHAALTETLRLYPAVPLDNKQCFSDDVLPNGFNVSKGDIVFYIPYAMGRMESLWGKDAESFRPERWLDENGVFQQESPFKFTAFQAGPRICLGKDFAYRQMKIFAAVLLRFFVLKLRDEKEIISYRTMITLSVDQGLHLTAMAR

SEQ ID NO: 14744 - protein, 257 aa, Zea mays
  unsure (1)..(257): unsure at all Xaa locations
MAAAATTSSSSHLLLLSRQQAASLRCRLSFLGQPRRPGRVTAQAPAAKDVRCMAAVDTTAASTAAEETSPKSSSYEIVTLTTWLLQQERTGAIDNEMTIVLASISTACKQIAALVQRAPISNLTGVQGAVNVQGEDQKKLDVVSNEAFSNCLTXKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFV

SEQ ID NO: 14745 - protein, 198 aa, Sulfolobus solfataricus
MSNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIVGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 14746 - protein, 340 aa, Trichodesmium erythraeum IMS101
MRIGINGFGRIGRLALRAAWEWPELEFVHINEIKGGTAAAAHLLKFDSVHGKWSLDVEAAGEQVIIDGKPLSFSEYSEPGEVPWEKLGVDIVLECSGKFRTKSTLEPYFQNGVKKVIVAAPVKEEALNVVMGVNDNLYDPEKHHLLTAASCTTNCLAPVVKVIHEGLGIKHGVITTIHDNTNTQIIVDAPHKDLRRARATSLSLIPTTTGSATAIGLIYPELNGKLNGLAVRVPLLNASLTDCVFEVVRPTTVVEINSLLKTASETPPLKGILGYEERPLVSIDYKDDPRSSIIDALSTMVVDETQVKILAWYDNEWGYANRMVELARKVVVSWKSGLSF

SEQ ID NO: 14747 - protein, 401 aa, Catharanthus roseus
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 14748 - protein, 340 aa, Streptomyces clavuligerus
MSVRDRLLACFVAVLWGLNFLAVRIGLDYYPPVFLSAMRFVVVAVPVILFVPRPKVPLRWLLVYGLGFGVIQFGLLFLAIDIGMPSGQASVVVQAAAPFTMLLGLLLGERISRRQAGGIVLAVAGMSAIAVERAQDAALLPLVLTLVAAFGWAMGNIASRQARPDHPLRFALWMCVLPPIPLLGLSAALEGPTAGWRALGDSLTSGDLTGPVALLYTALAGSVVGSGIWNTLMKRYEAGTVAPFSMLVPVVAVAVATIWLDERLTLWSAVSGAAVVLGVLVGTTRSRAAREAGPPPAAGRPPKAPAERGRMLRRRPPGPGDTGPDQSDGPASAVQNTQRS

SEQ ID NO: 14749 - protein, 99 aa, Malus x domestica
MGFRLPGIVSAKRSLIRSLSNSKQTASKTLDIPKGYFAVYAGERQKKRFVIPISYLNDPLFQDLLSQAEEEFGYDHPMGGITIPCSEYTFLHLTSRLSV

SEQ ID NO: 14750 - protein, 961 aa, Eremothecium gossypii
MSKRHTGEQSSPTEPVPGTGALTGPLEMLQAGSTVLVGVHQVEVIEYLAEGGFAHIYKVSFVGYTNELDRQDRILQPGDTVCLKRVRVSDENGLNELRNEVEVMKKLRNCSNIVQYYDSNASRLGDGKPGYEVLLLMELCPNGSLLDYMNQRLATKLSEAEVLKIMYDITVGLSHMHYQRTPLIHRDIKIENVLVDADNNFKLCDFGSTSPCLPAVASHQEIAMLMNNIYVHTTPQYRSPEMIDLYRCLPINEKSDIWALGIFLYKLLFYTTPFELTGQFAILHSKYEIPRNSFSSKLINLVIIMLAENPYLRPNVYQVMYHICSMMECEVKIDDLYGQGPYNFDMYGRYQEKLQRLQYDMLMSHQLAQRGIINTDKVNDLFISTFECAPKQPMVMGQNAVAQQQIFVAPPSTNTSMPVDMQQSLPKPLDHNGPNAHGGLDSLQKLPKSADVGNYPVAETHMHMYADAQKNYIQVPRKEVMMQHTDRSVLSDHSGNGTSTPSLPGSCPVQHEQLANTPKSKQYKKNNPFPKMAKQDFVHDTYDESDEHSPGDDPAPASKPVDSMIPSVPATVTPMVSVQRDRSFQHIQPGQIPENVRECEPESEVEMDLSHKIQNCNLDQQQSLQAQDLKLQQILLHQQQLQHRQYQQQNDNRQQHAQRLHDQMPHQQRQQLPLQMHLRPQHPCSNNVPLHKTLAEQAYQLSDSTQPQPQPQYQAYYVDRKTAVPFQTYSNAYTQNQHVFPQQSSRGTYGTSDRIQNGSNQLIEFSSPDKSANDAQLDLTYNQINLSKPNSVGGGDPSENASVELNGSGSSVLTNESIAMELPNAEERPVPPSTSGATQPAENIHSRQESDSYHDREDSRHVTGHVPRRSLELDFQEIDLSSSPTPVSASKTSSKAHLQPNRSGTANCGTSNSSSVVSGVRKSFHRGRKSVDLDVSKKESKEEPTNSGSGKRRSIFGVFKS

SEQ ID NO: 14751 - protein, 245 aa, Klebsiella pneumoniae
GTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGADKPTDLPAHLKNGNFLRPTVLADVNNRMRVAQEKIFGPVACLLPFKNKAEGLRLANDVEYGLASYIWTQDVSKVLRLARGIEAGMVFVNTQNVRDLRQPFGGVKASGTGREGGEYSFEGVR

SEQ ID NO: 14752 - protein, 391 aa, Helicobacter pylori 26695
MISFKEALKIHSSIPIKPLEIEVISLFESIGRILAEDIICIHALPKFNQSAMDGYGFKMQDLGKKTQVVQRIFAGDDVSALEVKENECVKIMTGAMVPKGIETIVPIECMLESHTNFALAPKDFKINANIRQKGENASLNSVLVPKNTRLNYGHIALIASQGLKEIKAFRKLKIALFSSGDELVPLGQNALECQVYDVNSVGIFNMLKNYNTHFLGVLKDDKNLQLKILESQDYDVILSSAGVSVGDKDFFKDALKEKNALFYYEKVNLKPGKPVTLARLNQSMIIGLPGNPLSCLLVLRVLILPLLERLSLNKDFKLKPFKAQINAPLKLKGERAHLILGNYSNHQFIPYNNNRYDSGAIQALARVDSIALIDEGVRLVQGEIEILRFEN

SEQ ID NO: 14753 - protein, 333 aa, Triticum aestivum
  unsure (1)..(333): unsure at all Xaa locations
GFAEAFDAACFPLTLFSSTFDQGWAAGISAAAIQGRFDRWGEGGAAWVNQCFLEAARYGSTELVRILRPFGRRNSLDIDVDLXLGRNLHSKQHRHRDRHRHRSSQASSEGXVAPTAERGCFQVVEWCVNRGCRDMELCLALTHATSSSQVEVAAYVVLCRACVCVVSLCVSCARGAVEYLPEPQPSEKKLIXASSLNDPAATYAVADSIARCADEAVDAKLRLFMLEQWSEEAFNKGFVSSQEHFVNITRIMQRGESPVVLRQLPLQLVIAMAYLPLYRECVGSGGRLLPQRLRGQLVEAAGRLEGRQLDRGMQQSELLAILEHHLPRFLVQT

SEQ ID NO: 14754 - protein, 170 aa, Bacillus cereus ATCC 14579
MDFKQHIAIVPDYPKEGIVFKDITPLMNDGKAYKAATDAIVEYAKERDIDVVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 14755 - protein, 431 aa, Compsopogon coeruleus
  unsure (1)..(431): unsure at all Xaa locations
AAAVEGESSTATWTVVWTDLLTACDLYRAKAFRVDAVPNAGDQYFAYIAYDIDLFEEGSIANLTASIIGNVFGFKAVKALRLEDMRLPVAYLKTFQGPATGVICERERMNNFGRPLLGATVKPKLGLSGRNYGRVVYEGLKGGLDFLKDDENINSQPFMRWRERFLFCMEGVNRASASTGEVKGHYLNVTAGTMEDMYERAQFGKEVGSIIIMIDLVIGYTAIQSMAKWARKNDMILHLHRAGNSTYSGQKNHGMNLRVIXKWMRMAGVDHIHAGTVVGKLEGDPLMIKGFYNTLLEPTLEIDLPKGIFFNQDFASLRKLMPVASGGIHAGQMHQLIEYLGVDVVLQFGGGTIGHPDGIQAGATANRVALECMVLARNEGRDYVNEGPQIIRDAAKTCGPLQTALDLWKDISFNYTSTDTADFVSTATGNV

SEQ ID NO: 14756 - protein, 495 aa, GIBBERELLA ZEAE PH-1
MTSTTQISLPNGKKYDQPTGLFINNEFIAATGDEFVVTNPHTEEEVIKLKGASKEDVDKAVQAARKAFEGEWSELAAVDRGAFLYKIADLIDRDRELIAAIDAFDNGKPFSACLAGDLDESYNVFRYYAGAADKISGKTIETSPAKLAYVLQEPLGVCGQIIPWNFPFMMLAWKVAPALACGNTVILKPAEQTPLSALYFGNLVKEAGLPAGVVNVLPGLGPSTGKAIAGHMDIDKVAFTGSTNTGRAIMKDAANNLKNITLECGGKSPSIVFADAELEQAVKWCHFGIMDNKGEVCTSTSRIYVHEDIYDKFLEKFVEVTKENDKLGAPFDESTVQGPQVSKTQYDRVLSYIEEGRKSGAKLLYGGSKHGGKGYFLQPTVFADTTEDMKIMKEEIFGPVVSIAKFSTDEEAIKKANDTSYGLAAALFTEKIARAHKVARKLQAGMVWINSSGDSHFGIPFGGYKSSGIGRELGQYALDAYTQPKAVHVNLGFEL

SEQ ID NO: 14757 - protein, 357 aa, SYNECHOCOCCUS SP. WH 8102
MAQHRVVLLPGDGIGPEITAVARQLLEAVSQRHGFELCFDGQLIGGSAIDACGEPLPASTLDACKAADAVLLAAIGSPRFDNLPRDKRPETGLLGLRSGMALFANLRPVKIVPALIGASSLRPEVIEGVDLMVVRELTGGIYFGQPKGRIQADGEERGFNTMTYSSSEVDRIARVAFDLARERRGNLCSVDKANVLDVSQLWRDRVDAMAPAYSDVEVSHMYVDNAAMQLVRSPRQFDVLLTGNLFGDILSDEAAMLTGSIGMLPSASLGSDCPGLFEPVHGSAPDIAGQDKANPMAMVLSAAMMLRIGLKQTEAAADLEAAVDKVLAAGFRTGDLMAEGCTALGCRAMGDALLKAL

SEQ ID NO: 14758 - protein, 387 aa, Corynebacterium efficiens YS-314
MRSQSSCHPGDNTGPGVKLGHVLPSDVESEHLNMTTPHHPTPVRAWGVTAFAQPLESLTITRRELRADDVSIDIEYAGICHSDIHTATGDWGEREYPLVPGHEIVGRVSAVGDAVTKHRVGDRVGVGCFVNSCGHCEPCRAGEHSYCDTGAVLTYGSEDRYADGEYTQGGYSQAIVVKEDFVVRVPESLDPAAATPLLCAGITTYSPLKHHGAGPGKKVGIIGLGGIGHVAVKIAVAMGAEVVVFSHSTSKREDALKFGATEHVSTADPTFAETWGGQFDLILNTVSVNLDTATYLSLLCFDGALVALGLPNDPMEVPTRMLTSKRRTLTGSLVGGIPETQEMLDFCAEHNITAEIELIDATSINEAYERTINSDVRYRFVIDAATF

SEQ ID NO: 14759 - protein, 481 aa, Malus x domestica
MTSILLGYDIGVMSGASLFIKENLKISDVQVEIMNGTLNLYSLIGSALAGRTSDWIGRRYTIVLAGTIFFIGALLMGFAPNYAFLMFGRFVAGVGVGYALMIAPVYTAEISPASFRGFLTSFPEVFVNIGILLGYVSNYAFSKLPIHLNWRIMLGVGAFPSVILAVGVLAMPESPRWLVMQGRLGDAKRVLQKTSESIEECQLRLDDIKEAAGIPKESNDDVVQVSKRSHGEGVWKELLLHPTPAVRHILIAALGIHFFEQSSGIDSVVLYSPRIFEKAGITSYDHKLLATVAVGVVKTICILVATVFLDKFGRRPLLLTSVAGMVFSLSCLGASLTIVDQQHGKIMWAIVLCITMVLLNVAFFSIGLGPITWVYSSEIFPLQLRAQGCSMGVAVNRVTSGVISMTFISLYKAITIGGAFFLYAGIAAVGWVFFYMLYPETQGRTLEDMEVLFGKYHKWREANALLQKAKQVDGDDKGQVH

SEQ ID NO: 14760 - protein, 265 aa, Glycine max
  unsure (1)..(265): unsure at all Xaa locations
QVITLSITGALNAVLTEEHRKEICRYLYNHQXEGPNDGQGEMEKARDLILGHGGATYITSWGKMWXSVLGVYEWSGNNPLPPEIWLLPYMLPFHPGRMWCHCRMVYLPMSYLYGKRFVGPISPTVLSLRKELYTVPYHDIDWDQARNLCAKDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIE

SEQ ID NO: 14761 - protein, 167 aa, Nicotiana tabacum
DSRTTIFSPEGRLYQVEYAMEAIGNAGSAIGILAKDGVVLVGEKKVTSKLLQTSTSTEKMYKIDDHVACAVAGIMSDANILINTARVQAQRYTFSYQEPMPVEQLVQSLCDTKQGYTQFGGLRPFGVSFLFAGWDKNYGFQLYMSDPSGNYGGWKAAAIGANNHAAQ

SEQ ID NO: 14762 - protein, 179 aa, Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 14763 - protein, 224 aa, Aristida longiseta
IENKISRQVTFAKRRNGLLKKAYELSLLCDAEVALIIFSGRGRLFEFSSSSCMYKTLERYRSCNYNPQEAKAPQESEINYQEYLKLKTRVEFLQTTQRNILGEDLGPLSMKELVQLENQIEISLKQIRSRKNQMLLDQHYDLKNKEQKLQDLNKDLRKKLQETSGENALHISWEEGGHSGASGNAIEPNQGFLQHPENDSSLQIGYHQQAYMDQLSNEDMGAHH

SEQ ID NO: 14764 - protein, 331 aa, Zea mays
YLFSSLKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVSDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 14765 - protein, 1066 aa, Arabidopsis thaliana
MVDVEEGEIPDSVNTEIEVKHKSTTTTADVGGDVDVGVVAGGRGGGGGGSNGNSRVWTMEELISQYPAYRPYANSGLSNLAWARAVQNKPFNEGLVMDYEPRESDKIVIEDSDDEKEEGELEEGEIDLVDNASDDNLVEKDTESVVLISADKVEDDRILKERDLEKKVKLIRGVLESTSLVEAQTGFEGVCSRILGALESLRELVSDNDDFPKRDTLVQLSFASLQTINYVFCSMNNISKERNKETMSRLLTLVNDHFSQFLSFNQKNEIETMNQDLSRSAIAVFAGTSSEENVNQMTQPSNGDSFLAKKLTSESTHRGAAYLRSRLPMLPLLDLHKDHDADSLPSPTRETTPSLPVNGRHTMVRPGFPVGRESQTTEGAKVYSYESDARKAVSTYQQKFGLNSVFKTDDLPSPTPSGEPNDGNGDVGGEVSSSVVKSSNPGSHLIYGQDVPLPSNFNSRSMPVANSVSSTVPPHHLSIHAISAPTASDQTVKPSAKSRDPRLRLAKPDAANVTIYSYSSGDARNLSKVELSADLVNPRKQKAADEFLIDGPAWKRQKSDTDAPKAAGTGGWLEDTESSGLLKLESKPRLIENGVTSMTSSVMPTSAVSVSQKVRTASTDTASLQSLLKDIAVNPTMLLNLLKMGERQKVPEKAIQKPMDPRRAAQLPGSSVQPGVSTPLSIPASNALAANSLNSGVLQDSSQNAPAAESGSIRMKPRDPRRILHGSTLQRTDSSMEKQTKVNDPSTLGTLTMKGKAEDLETPPQLDPRQNISQNGTSKMKISGELLSGKTPDFSTQFTKNLKSIADMVVVSQQLGNPPASMHSVQLKTERDVKHNPSNPNAQDEDVSVSAASVTAAAGPTRSMNSWGDVEHLFEGYDDIQRVAIQRERVRRLEEQNKMFASQKLSLVLDIDHTLLNSAKFNEVESRHEEILRKKEEQDREKPYRHLFRFLHMGMWTKLRPGIWNFLEKASKLYELHLYTMGNKLYATEMAKLLDPKGVLFNGRVISKGDDGDPLDGDERVPKSKDLEGVMGMESSVVIIDDSVRVWPQHKMNLIAVERYHLSHYG

SEQ ID NO: 14766 - protein, 287 aa, Oryza sativa
MRHVATSGEDRYAAAGGGGDSGGGKLWNLCRMPFWQPGGAPATASAPPPPSSSSSSAGIHHHSAGRYGHEGGGGGAVAGDGAPAGSISSVAKSLLPARRRLRLDPPNKLYFPYQPGQQVRSAIRIKNTSKSHVAFKFQTTAPKSCFMRPPGAILAPGETIIATVFKFVEHPENNENVLQKCKVKFKILSLKVKGPMDYAPEMFDEQRDQAVVEKILRVVFLNVENPGPQLEKLNNQLAEAEAALEARKKPPEENGPKIVGEGLVIDEWKERRERYLAQQQVEVVDSV

SEQ ID NO: 14767 - protein, 327 aa, Triticum aestivum
MLLLFALLAGAAAAAFLLFKFATADGDFTLLSCGRARRDKVDGKVVWITGASRGIGEVLSMQFASLGAKLILSARNKEELERVKRNIISKHPDSKVEVLPMDLSSDEESLKEVVHSAESLFSSAGIDYMMHNAAFERPKRGALEETEEGLKATFHVNVLGTITLTRLLAPFMLDRGMGHFVVMSSAAGKVPTPGQALYSASKHALNGYFASLRSELCTKGIKVTVVCPGPIETPVPSGATSSSQRHSSEKRVSVERCAELTIVAATHGLKEAWISYQPVLAVMYVVQYMPTIGCWLMDKVGAKRVDAAAKKGNAYSWNLLFGGKKSA

SEQ ID NO: 14768 - protein, 154 aa, Triticum aestivum
  unsure (1)..(154): unsure at all Xaa locations
VTVGKFQGGGAFNVIPDSVTIGGTFRAFLKESFNQLKQRIEELLCGYMRRDGHEGDVSSQGRDDTVMFGPNDDGVKIPTQVETLVKGTAMVAEPEYKAIPDLDYLXELLAIQQQGPRAIGFFGTRNMGFMHQQLIEILSYAMVITKNHIFTSGA

SEQ ID NO: 14769 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 14770 - protein, 344 aa, Cytophaga sp. KUC-1
MLPKTMKAAVIREFGSLLKIEEVEVKRPGRNEILVKVIASGVCHTDLHAVEGDWPVKPKMPLIPGHEAVGYVVAVGQEVKNVKEGDAVGVPWLYSACGGCDQCITGWETLCDTQQNGGYSVDGGFAEYVIADARYVGLLPSNVNFMEMAPILCAGVTVYKGLKETEVKPGEWVAISGIGGLGHVAVQYAKAMGMHVAAIDVADDKLDLAKKLGADLVVNAKNQNPGEFLKKEVGGMHGALITAVSPIAFKQGLETLRRKGTMALNGLPPGNFDLSIFDTVLNRITIRGSIVGTRKDMKEAIEFAVEGKVKATVTPAKLENINEVFDKMKKGQIEGRVVLEIAKA

SEQ ID NO: 14771 - protein, 481 aa, Pseudomonas syringae pv. syringae B728a
MSQKTLTTASGAPVADNQNSRSAGPRGPLLLDDFHLIEKLAHFNRENIPERRVHAKGSGAHGTFTVTRDISQYTSARLFDTVGKQTPIFLRFSTVGGERGSADTERDPRGFAIKFYTEEGNWDIVGNNTPVFFIRDPLKFPDFIHTQKRLPQTNLKSPQMMWDFWSHSPEALHQVTILFSDRGIPDGYRHMHGFGSHTYSLISAAGERHWVKWHYKTRQGIKNLTPAEAARIAGTDPDYAQRDLFTAIEKGDFPKWQVCIQLMTEAQAANHHENPFDVTKTWSQKEYPLIEVGELELNRNPLNYFAEVEQAAFGPSNMVPGVGLSPDRMLQGRVFAYADAHRYRVGTNHQQLPINAPKSPVHSYQRDGAMAFGTNGGATPNYEPNSYSDAPKENPRYAEPALSLNGAADRHDHRVDGDYYSQAGKLFNLMSADQQALLIGNIAGAMAGVSSDVVQRQLQHFYKADPAYGEGIARALDVKLG

SEQ ID NO: 14772 - protein, 299 aa, Streptococcus pyogenes M1 GAS
MTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 14773 - protein, 419 aa, Grateloupia sparsa
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMAVWARKNDMILHLHRAGNSTYSRQKSHGMNFRVICKWMRMAGVDHIHAGTVVGKLEGDPVMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTW

SEQ ID NO: 14774 - protein, 365 aa, Caulobacter crescentus CB15
MSQGDGQPSRCHGRSHPLIATLLGPSVLFFQRFFRLMTALYDVAAIGNAIVDVIAQCDDAFLEREGLVKGSMALIDPARAASLYDVMSAAIEASGGSAANTVAGVASFGGKAAFLGKVADDQLGRVFRHDMNAIGCVFTTPPLAEGPATAQSLINVTPDAQRTMSTYLGACVELNPADVDPDIIEAAQISYLEGYLFDPPEARRAFAKAAALAHGSDRKIALTLSDSFVVDRHRGALLGFVETQCDIVFANAAEVCALFETDDFDAAVKALAERCEIAAVTRSEKGSVVAANGQLHEISAYPVEKVVDTTGAGDQYAAGFLFGLSQGRPLPICGQLGSLAAAEVIDHYGPRPQVSLRELAEKNGL

SEQ ID NO: 14775 - protein, 432 aa, Escherichia coli O157:H7 EDL933
  unsure (1)..(432): unsure at all Xaa locations
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKXSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 14776 - protein, 850 aa, ASPERGILLUS NIDULANS FGSC A4
MYRQEATTVTILAQAPPNWPAPAFDISGFTSAFRPSRRAQRSNTTMGSIDTNSTDAWHTFAIPRLGIPAMRITDGPNGARGTRYFNGVPSACLPCGTALGATFDTDLLFKLGRLLAAECKAKGAHVLLGPTINIQRGPLGGRGFESFSEDPVLSGNSAASYCAGVKDLGIVPTLKHLVCNDQEHERIAVSAMVTERALREIYLMPFQLAIKNARPGALMTSYNKVNGLHASEDPGLLNHIIRKEWGFEGLIMSDWFGTYSVASAVNAGLDLEMPGPTRFRGPALMHALTSNKVSEKTLDDRVRKVLELVQLTSRAGIPEYAPAQKLDRVEDRVLLRQAAADSIVLLKNANEVLPLDPRKKTLVIGPNADIAAYCGGGSASLLAYYTVTPRQGIAEKCEEVVFSQGCYGHKELPLLGDHLKTETGERGYTFRVYTEPATYEDRQPVDVLHMTNSCAFLMDYSHPKISGDTYYATLEGRFEPTESGVYELGLTVAGTGLLYIDGELVIDNKTKQRHGTSFFGIGTVEERGERYLEAGRQHHVFVEYSTAPTSNLKHHGVVSFGPGGVRLGGCRKLDAETAIKQAVQLAAETEQVVVCVGMNGNWESEGFDRPHMDLPPGTDNLVRAVIEAQPNAVIVVQSGTPVTMPWADQAKALVQAWYGGSEGGNGIADVLFGDVNPSAKLPLTFPRDIAHNPSYLSYRSERGRVLYSEDVYVGYRYYDKVKQAPLFHFGHGLSYTTFKLSGLNVQETDPQASDISAEVVQIYVRPPTTASVGRPVRELKGYEKTMLHPGETKEISVTVPMGVATSFWDEGRSAWLSEKGTYAIEVVGTGERNMLSAPLCVQVSRYWNGL

SEQ ID NO: 14777 - protein, 251 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 14778 - protein, 541 aa, Dechloromonas sp. RCB
MLADGGVLRHVFLGNGGRLGPGSIAACLRGQGAQDVFHAGQRPVQIDGRRPCRAEQGDRFGQSSVGCLEIKRNGQAVSRSRANKRCAAHLHGADGVGCLLQRGDADPVQCMRQPGLVDDVDGAPVGMGAQGAGGDAVDVHGPHCGIVPSSKTPARTMDTPIRIDSRFPNMGTTIFTVMSRLAAECGAVNLSQGFPDFQAEPALFDAMHRHMLAGRNQYAPMAGLPELRQAIADKVAALYGTRFDVESEVTVTAGATQAIFTAIAAFVRPGDEVLVFEPVYDSYVPAIETVGGTAVYAQLKFPDYTPDWAQVAGLISPKTRMIIVNSPHNPTGSLLTAADLDKLAELVRGTDIVILSDEVYEHILFDGEQHASLCGHPELAVRTIVVSSFGKTYHITGWKIGYVVGPAALMAEFRKVHQFNVFTVHAPSQLAIAEYMQDASRHLGLAAFYQEKRDFFRQLMAATPFELLPCRGTYFQLARYDRISDLPDRAFAEWMAREVGVAVIPVSVFNADGRDDKVVRFCFAKREETLRAAAERLCKAL

SEQ ID NO: 14779 - protein, 93 aa, Zea mays
  unsure (1)..(93): unsure at all Xaa locations
WTYIYVITRRRGGDDHTDTWLKSRHMFHRGCNPTIXVDMVLIDESYARGAVPSGASTGIYDALELRDGGSXYLGXGVVKAERNVNNIFVPINC

SEQ ID NO: 14780 - protein, 114 aa, Synechocystis sp. PCC 6803
MAQGKGFGFGLGKIKELQEAFQKAQQVQEGAKVLQEELERMEIPGKSADGLVTVLMSGNQEPLSIEIDPSALEKGAEGLSASVTEAMKAAYAESTETMRSKMEELTSGLNLPGM

SEQ ID NO: 14781 - protein, 196 aa, Mitthyridium sp. Mohamed 1995
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSCDFITDSQSSIFDAKAGIALSDTFVQL

SEQ ID NO: 14782 - protein, 117 aa, Triticum aestivum
LVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGEGNAEQSW

SEQ ID NO: 14783 - protein, 432 aa, Marchantia polymorpha
MAASSMISSTLASSISTTLQSGAKAEGRNANSQSMVAFSNQGRSVNMQTKGSFFSSTELLSSGTPSRKQQLSGPIRATATQTPTISKKSGSKEKAKIGINGFGRIGRLVLRIALSRDDVEVVAVNDPFLTADYVRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFGIVQGLMTTVHATTATQKTVDGPSGKDWRGGRGAGQNIIPSSTGAAKAVGKVLPELNGKLTGMAFRVPTPNVSVVDLTCRLEKKASYDDIKKVIKAASESSMKGILGYTEDAVVSSDFIGDARSSIFDAHAGIGLGDGFMKFVSWYDNEWGYSNRVVDLIEHIAAVVSAKKN

SEQ ID NO: 14784 - protein, 266 aa, Shigella flexneri 2a str. 2457T
MLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHSTRPAVMSLVIWSALIPIIPFFVVSLILDGSASMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 14785 - protein, 492 aa, Glycine max
MDPYKHRPSSAFNSPFWTTNSGAPIWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRSWAPDRQDRFARRWVDALSDPRVTHEIRSVWISYWSQADRSLGQKIASHLSTRPNI

SEQ ID NO: 14786 - protein, 801 aa, Rhodobacter sphaeroides
MPVNDQSLTPNVLKTDVMRHLTFTLGKDAPHASLYDWRMALSYAIRDRIMEPWFASTRRTWEEDRKRVYYLSMEFLIGRILEDATINLGLHEMAERTMAELGQDFKAIVGDEPDAALGNGGLGRLAACFMESMATLGCPAYGYGIRYEHGLFRQRFEGGQQVETPEDWLSQRNPWEFDRPEATYIVGFKGHVETRDGREVWVPAETVKASAHDTPVVGWQGRWANTLRLWGAEPTTLFDLERFNRGDYTAAAEPETLARTLSRVLYPDDTTYQGKELRLKQEFFLTSAALQDILRRFKSGHGDLRALSRHVAIQMNDTHPAIAGPELIRLLVDEHGLSFDEALPVAQECLGYTNHTLLPEALERWATFTFGNVLPRHMQIVERIDGWHRRTFPARPHYVGIVKHHEVRMGELAFIMSHKVNGVSALHTDLVKANLFPELDRLHPEKIVNQTNGVTPRRWLKMANAPLARLIGETIGEGWEDDLDRLKGLEPHVKDQGFLGAFDAAKRQNKVTLSNWLGAECGVKVSPDALFDVQVKRIHEYKRQLLNILETVARWQAIRANPDAGWVPRVKIFGGKSAPGYAVAKEIIHLINDVAAVINADPLVGDLLKVIYPANYNVSMAERLVPAADLSEQISTAGKEASGTGNMKFMMNGAPTIGTLDGANVEILQEVGRENFFLFGLTAEEVMKRREDPDHARKAIEASQIMQNVLQAIAEGQFSPGQADRYHGLVHRVWHHDYFLVASDFDAYLAAQAEVDAAYKDRARWLTMAALNTARSGFFSSDRTIRGYMKEIWGVESALQD

SEQ ID NO: 14787 - protein, 403 aa, Glycine max
MASDGFTDKNTVFRKLKAKSENKMCFDCNAKNPTWASVTYGIFLCIDCSAVHRSLGVHISFVRSTNLDSWSPEQLKTMSFGGNNRAQVFFKQHGWNDGGKIEAKYTSRAADLYRQILSKEVAKSMAEDGGLPSSPVASQSAQGVNGLPEVKTNEVPKENTLEKPEKPESTSSPRASHSVISGTVKKPIGAKKAVKSGGLGARKLTKKPSESLYEQKPEEPPAPVPSSTNSMPAGPSPTSRFEYVENVQSSDLNTGGSHVLSHVSPPKSSSFFADFGMDGGFPKKSGPSSSKVQIQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 14788 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLTPKGWKVQLWYRSVHMDPQVYPDPTKFDPLRWEGHSPRAGTFL

SEQ ID NO: 14789 - protein, 358 aa, SYNECHOCOCCUS SP. WH 8102
MDVEHRHGGNRASIATRLGCRPSDLLDASASLVPWTPRLPRLSRSIIRDYPDRSHNLLRCDLARLHGVPCELLLAGNGAAELFTWAARDAASSGPSLVPSPGFADYSRALGCWDGPWVRHQLPLSWSADRPQPIPQTPEAEVLWICNPHNPTGQLWSRASLEPLLRRFRLVICDEAFLPLVPDGEHQSLIPLVAETGNLVVIRSLTKLYGIAGLRLGYAVAQPERLQRWAQWRDPWPVNGIAMAVGQHVLSSTRRHQRWCRKTQAWAAREGAWMQQQLAVLPGITPMPSAVNYLLIRANRSLLPLREALEQHHRILLRDCRSFEGLGENWLRIGLQSRRNNRRIVSAMRKELSRTPLG

SEQ ID NO: 14790 - protein, 419 aa, Triticum aestivum
MENMRSENNRGAAMEGVKLASEAAANTNRRALRDIKNILGAPHQPQAVSKRGLQEKPAAGAKSQAGAVGHRPVTRKFAAILQQTQPANAPLAPIGSERQKRNADTAFNAPSDMECSKASDDDLDEMMTNELKEIDREDTKEEEEMPDIDSCDVGNSLAVVEYVDEIYSFYRRTEELSCVSPTYMAHQSDINEKMRGILIDWLIEVHYKLELLGETLFLTVNIIDRYLARENVARKKLQLVGVTAMLLACKYEEVSVPVVEDLILICDRAYSREDILDMERTIVDRLEFNMSVPTPYCFMRRFLKAAGSDKKLELLSFFLIELSLVDYKMLKFQPSMLAAAAIYTAQCTLNGCVSWSKCCELHTKYSEEQLMDCSTMMVELHRGAARGKLTGVHRKYSTFKYGCAAKSEPAAFLLDARRA

SEQ ID NO: 14791 - protein, 313 aa, Bacillus cereus ATCC 14579
MRNVFCIGELLIDFVCRNTNVSLVNGSDFEKKAGGAPANVAAAITKLGGHATFMGQVGNDPFGEFLEQTLQRAQVDTSMLIKDKQTTLAFVSIDQDGERDFTFMRGADGEYQFNSIDLSKIQTNDLIHFGSATALLSSPLKETYFQLLQYAKDKGHFISFDPNYRSALITNTEQFSQDCLTFIKHAHFVKVSQEEATMLSKESDLQQAALKLLNYGAKVVAITLGKDGTLLATNEGQTIVSSISIQQVDTTGAGDAFVGAMLYQIAQSEHTLSYHFKDLTAFISFANKVGAITCTNYGAIASLPSLTDIKAYD

SEQ ID NO: 14792 - protein, 77 aa, Zea mays
  unsure (1)..(77): unsure at all Xaa locations
ESDKGPCTLVRVCYECNYVSFHRRRVICGGVAISHAYYRGECTHXERDWYGCAXIVNLGSAEIDLFYECNKYGFRKR

SEQ ID NO: 14793 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 14794 - protein, 393 aa, Clostridium perfringens str. 13
MEGRLVSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDQSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEVIEECAMVK

SEQ ID NO: 14795 - protein, 361 aa, Schedonorus arundinaceus
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVEKGLTSQIEVVKMDYLNQALERLERNDVRYRFVVDVAGSNIDDTAA

SEQ ID NO: 14796 - protein, 481 aa, Arabidopsis thaliana
MARTTRERVKSFINNRWLVFVAAMWIQSCAGIGYLFGSISPVIKSSLNYNQKQLSRLGVAKDLGDSVGFLAGTLSEILPLWAALLVGSVQNLVGYGWVWLIVTGRAPILPLWAMCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRYDTTGCYSSGSACNVSRTHLLCIRMAWSYAHRHTIDWTWLWCSLGHRPSHCL

SEQ ID NO: 14797 - protein, 155 aa, Xylella fastidiosa 9a5c
MNVAFDLTPPSPSQREALIATLNAEEHRILLQHGTEAPFCNRLLDNNQLGTYTCRFCGLPLFHSNAKFKSGTGWPSFFEPYTHAHIRKQHDTSHGMIRTEILCARCNSHLGHLFPDGPPPTYERYCLNSVSLTFIPTGTLLPDQLHRGDNTAYRT

SEQ ID NO: 14798 - protein, 444 aa, Lomentaria hakadotensis
  unsure (1)..(444): unsure at all Xaa locations
RVTPQPGVDPVEASAAVAGESSTATWTVVWTDLLTACDLYRAKAYKVDRVPNSTDQYFAYIAYDIDLFEEGSIANLTASIIGXVFGFKAVKALRLEDMRLPIAYLKTFQGPATGVVVERERMDKFGKPFLGATVKPKLGLSGKNYGRVVYEGLKGGLDFLKDDENINSQPFMRWKERFLYSMEAVNRSIAATGEVKGHYMNVTAATMEEMYERAEFAKQLGXIIIMIDLVIGYTAIQTMAIWARKNDMILHLHRAGNSTYSRQKSHGMNFRVICKWMRMAGVDHIHAGTVVGKLEGDPLMIRGFYNTLLLTHLSVNLPQGIFFEQDWASLRKVTPVASGGIHCGQMHQLLDYLGIDVVLQFGGGTIGHPDGIQAGATANRVALESIVLARNEGRDYVAEGPQILQDAAKTCGPLQTALDLWKDITFNYTSTDTADFVETPTANV

SEQ ID NO: 14799 - protein, 402 aa, Pseudomonas putida KT2440
MENMHSAMDSLVHGSNTLFILMGAILVLAMHAGFAFLEVGTVRHKNQVNALSKILSDFAISALVYFFIGYWIAYGVNFFQPATTLAVDHGYALVKCFFLLTFAAAIPAIISGGIAERARFVPQLCATALIVAFVYPFFEGVVWNGNLGLQAWLQARFGAPFHDFAGSVVVHAMGGWLALAAVLLLGARRGRYRDGRLVAFAPSSIPFLALGSWILIIGWFGFNVMSAQTLQGVSGLVAINSLMAMVGGTLSALLAGRNDPGFLHNGPLAGLVAICAGSDLMHPVGALATGLVAGALFVWTFTAAQNRWKIDDVLGVWPLHGLCGVWGGIACGVFGQVALGGMGGVSLVSQLLGSLMGVLVALAGGFAVYGAIRALHGLRLSHEQEFQGADLSLHRIGATSQD

SEQ ID NO: 14800 - protein, 363 aa, Buchnera aphidicola
MKQKYRIAILPGDGIGPEVMREAYKILNILKNDFLLPLEFQEFNIGGIAIDNEGLALPKKTLLGCENADAILFGSVGGKKWDTLPIDQRPERAALLPLRKHFNLFANLRPAKLYSELEYLSPLCSKITKNGFDILCVRELTGGVYFGHPHGRVKKDDIEYAFDTEVYYDYEINRIAHLAFQLARNRKNKVCSIDKSNVLNSSLLWKEIVEKVSNSYSDVRLSHLYIDNATMQIIKNPNQFDVLLCSNLFGDIISDECAAISGSIGMLPSASLNENNFGLYEPAGGSAPDIEGKNIANPIAQILSVSMLVRYGMHLTKIADQIDKSVISVLKRGYRTADISNNNNYLKTHEMGDVIADALINGK

SEQ ID NO: 14801 - protein, 520 aa, Candida albicans
MSTPIEFKSSNSVTKDDHLYTKFTYENSVVEKDANGKFIVTPTASDYEFKVDLKVPKVGLLLVGIGGNNGTTLLGATLANKHNISFENKEGVVKPNYYGSVTQASTVKIGVDKETGEDVYVPFNSIVPMVNPNDLVVDGWDISGLPLDQAMKRAKVLDVTLQKQLYPYLENKKPLESIYYPDFIALNQSERANNVFNQVNGEVKTDNKWADVEKIRKDIRDFKAKNELDKVIILWTANTERYADVLPNVNDTADNLIKSIKESHEEIAPSTVFAVASILEKVPYINGSPQNTFVPGVIELAEKYDSFIGGDDFKSGQTKIKSVLAQFLVDAGIKPLSIASYNHLGNNDGYNLSSPKQFRSKEISKQSVVDDIIESNELLYNKESGDKVDHCIVIKYLPAVGDSKVAMDEYYSELMLGGHNKISIHNVCEDSLLATPLIIDLVVATEFATRVQVKGPGKSDYDELYPVASLLSYWLKAPLARPGFKPINGLNKQRQQLVNLLSVLVGLPIDNELRFERILK

SEQ ID NO: 14802 - protein, 174 aa, Oryza sativa
  unsure (1)..(174): unsure at all Xaa locations
MPYLSTAYSGGSGLQASYPLYPESPSSSLISPASATPRTGLXPIPEQEVCTAHWKTSXAASAQFYLDQAQQSFPYNNGGRISVSKDKQDVEEVEAYRASFGFSADEIVTTQTYVEIPDALDEGFSISPFGNNAPATEVDKSLFNVKVITGPKKSTEQKLSNGSPQNVVHLDIFK

SEQ ID NO: 14803 - protein, 101 aa, Glycine max
  unsure (1)..(101): unsure at all Xaa locations
TRPTGCKRPPKGGGWDIINLNLSDAMVRAKAFDIHLHKQLRTYMESIVPLCGIYDPYFIAANXGDRSNNLIKGTWYEHEQQMINDIKEFKESTRVDMVEPM

SEQ ID NO: 14804 - protein, 610 aa, Glycine max
  unsure (1)..(610): unsure at all Xaa locations
RRNLRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILDKEIKEQAXAVSDRRPLLPHXSASADVRSLTMDDCKYAPQQVCASXRLLLNSYNI

SEQ ID NO: 14805 - protein, 210 aa, Streptomyces venezuelae
MKVLLIDAYDSFVHIIDQYLRTLGADTEVVRSRTRSPEELAAARPDAVVLGPGPGHPADSGHVELVHRFAGRVPLLGVCLGHQAIALAYGGRVDVADELMHGRTSTVRHDGAGIYRGLGNSLEATRYHSLVVAEPLPEELLVTAVAADHGYVMGLRHRSLAVEGVQFHPESIMTTAGLTLLENFLSTAGSPTPGGAAAHEDAGLTGARPR

SEQ ID NO: 14806 - protein, 216 aa, Ranunculus bulbosus
  unsure (1)..(216): unsure at all Xaa locations
GLVKKAHEISVLCDAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPCLNIGGNYQGGSSGREDEVPQTQARPTILMPPWMVXHL

SEQ ID NO: 14807 - protein, 412 aa, Ricinus communis
FRQITKNQKKKVRKKTMALKLNPFLSQTQKLPSFALPPMASTRSPKFYMASTLKSGSKEVENLKKPFMPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKL

SEQ ID NO: 14808 - protein, 337 aa, Zea mays; identical to SEQ ID NO: 3844

SEQ ID NO: 14809 - protein, 629 aa, Zea mays
  unsure (1)..(629): unsure at all Xaa locations
MATMLRRCMRDLRPLRSLARVPRPIFGESPTFLKSRSNSTKASPKSSTQNAAPGPQGHPSQSGSNVSKLVLGTLVVGAAAIGAHQLGYIDLQFTDKTLPFSLTKEDAEKAIYEDLKXPSEQKVDQTQNVSGQNAEIVQENNNEAHTPKGVLNDGMGALEVPINEDQLVPAEEKKSQTLAHETHPVPDEHGSDTKMPSEDSLAVEIETVPIDANESSEVPHEQQTDRIDSTIPPTQSTPTTVSTYDHPTDPDAPKDLSGAGAVEQKSLAETYFLQDEPDVSKDATIKEKRSDEVIREKTSKDGKIVLDIIEAIHAAEKKQADVDAYMYSEERRKLKEKYEKELKDTRARGTDVCRGGSNSGXKELKKEKLKNAAALKELQEKAEQKLQDELQRKDXETSQQIEKAQEIAKAELAAAVAKEKASQIEQIAEANLNIDALCMAFYARSEETRQSHSVHKLALGTLALEHALSSGSPIRSEVELLRKSVEGIDKDSLLELALSSLPEDVLDYGSDTMMGLKQKFNSLKETIRHFSLLPAGGGGILAHTVARVASSIKIKGDNSGDGIESLINKVERLIVDGDLITAADALEQGLHGTEAEEIATEWVKQARKRAIAEQTLALLQACASSTTFS

SEQ ID NO: 14810 - protein, 398 aa, Burkholderia fungorum
MNSVTEPLVRLAARVDAIQPFYVMELAKEAALLERDGRDIIHMGIGEPDFTAPEPVIEAAASALRRGVTQYTNALGLHALREAISAHYADFYGVSVDPARIVVTAGASAALLLACAALVDRDDEVLMPDPCYPCNRHFVIAAEGKPVMVPSGPAERFQLTAADVERLWNERTRGVLLASPSNPTGTSIEPAELERIVKAVRARGGFTIVDEIYQGLSYDAKPISALSFGDDVITVNSFSKYFNMTGWRLGWLVVPPGMVSAFEKLAQNLFICASALAQHAALACFEPDTIAIYEARRLEFKRRRDFIAPALQSLGFSVPLMPDGAFYVYADCRTVAHPAAGDSAALTRAMLHDAGVVLVPGMDFGTHAPKDYIRLSYATAYPKLEEAVGRLAKLFGKD

SEQ ID NO: 14811 - protein, 393 aa, Nicotiana tabacum
MDGSGQQTDTMMSDAGAEQPPTAPQPVAGMDNIPATLSHGGRFIQYNIFGNIFEVTAKYKPPILPIGKGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPTAIDLVEKMLTFDPRRRITVEGALAHPYLNSLHDISDEPICMTPFSFDFEQHALTEEQMKELIYRESLAFNPEYQHM

SEQ ID NO: 14812 - protein, 744 aa, Hypocrea jecorina
MRYRTAAALALATGPFARADSHSTSGASAEAVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWDAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 14813 - protein, 337 aa, Tropheryma whipplei str. Twist
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANLASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAASAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 14814 - protein, 492 aa, Prunus persica
MDPYKYRPSSAFDSPFWTTNSGAPVWNNNSSLTVGSRGPILLEDYHLVEKLANFDRERIPERVVHARGASAKGFFEVTHDISQLTCADFLRAPGVQTPVIVRFSTVIHERGSPETLRDPRGFAVKFYTREGNFDLVGNNFPVFFVRDGMKFPDMVHALKPNPKSHIQEPWRILDFFSHHPESLHMFTFLFDDLGVPQDYRHMEGSGVNTYTLINKAGKAQYVKFHWKPTCGVKCLLEDEAIKVGGANHSHATKDLYDSIAAGNYPEWKLYIQTIDPDHEDRFDFDPLDVTKTWPEDILPLQPVGRLVLNKNIDNFFAENEQLAFCPAIVVPGVYYSDDKLLQTRIFSYSDTQRHRLGPNYLQLPVNAPKCSHHNNHHEGFMNFMHRDEEVNYFPSRYDPVRHAERFPIPPNILSGKREKCIIEKENNFKQPGERYRSWAPDRQERFIHRWVDALSDPRVTHEIRSVWISYWSQADKSLGQKLASRLNVRPSI

SEQ ID NO: 14815 - protein, 343 aa, Glycine max
MELGIFRGTHIKIFCMCLPEGERGMALEAVVYPQPQDPFGHGIKDPSYNYNNLLEGGGGNWGYADFNLEKEDRTCVPFLANQTENYPYGEWNCSPSPPSMLPQLNIASNPQSSETSNTQNNLDSSVSTPARPKRRRTKSRKNKEEIENQRMTHIAVERNRRKQMNEYLSVLRSLMPESYVQRGDQASIIGGAINFVKELEQRLQFLGAQKEKEAKSDVLFSEFFSFPQYSTSASGGCDNSTAMSEQKSEAQSGIADIEVTMVESHANLKIRSKKRPKQLLKIASSLHGMRLTILHLNVTTTGEIVLYSLSVKVEEDCKLGSVDEIAAAVYQILDRIQQETISN

SEQ ID NO: 14816 - protein, 503 aa, Azotobacter vinelandii
MKLAPLWRGLPWRMIAARFYPNSRGSFRGSLHLEDNMSKSLQLIKEHDVKWIDLRFTDTKGKQQHVTMPARDVDDDFFEYGKMFDGSSIAGWKGIEASDMILMPDDSTAVLDPFTEEPTLIIVCDIIEPSTMQGYDRDPRAIARRAEEYLKSTGIGDTAFFGPEPEFFIFDEVKYKSDISGSMFKIFSEQAAWNTDADFEGGNKGHRPGVKGGYFPVPPVDHDHEIRTAMCNALEEMGLKVEVHHHEVATAGQNEIGVSFNTLVAKADEVQTLKYCVHNVADAYGKTVTFMPKPLYGDNGSGMHVHMSIAKDGKNTFAGEGYAGLSDTALYFIGGIIKHGKALNGFTNPSTNSYKRLVPGFEAPVMLAYSARNRSASIRIPYVNSPKARRIEARFPDPSANPYLAFAALLMAGLDGIQNKIHPGDAADKNLYDLPPEEAKEIPQVCGSLKEALEELDKGRAFLTKGGVFSDDFIDAYLELKSEEEIKVRTFVHPLEYDLYYSV

SEQ ID NO: 14817 - protein, 157 aa, Frankia sp. FE39
ITKEQYSRDPRNIAKKAEEYLRGTGIADTAYFGPEAEFYIFDDVRYDYSPSGSMHAVDSVEAAWNTARKEEGGNLGYKPRFKGGYFPVPPTDHFTDLRSEMTRVLFDVGITVEMQHHEVGTAGQAEIDIRYDTLLKTADNLMLYKYVIRNVARSRGK

SEQ ID NO: 14818 - protein, 288 aa, Triticum aestivum
  unsure (1)..(288): unsure at all Xaa locations
SKLELQRRADDTSTASAMAAEYDRTADLRALDATCSGVRGLVASGVTHLPRIFRVSDGVHQPQPPPPQVPSQELPSSSAPSVPVIDLSGSDHAAVVAAVRRAAAEWGFFQVTGHGVPEAAMAAATDAVRGFHEADGGEGSDKARLYSREPARAVKYHCNFDLYQSPVANWRDTLYLRMAPDQPDAGDLPDSCRDALFEYAEQVKNLGSTLFELLSEALGLKPSYLTDIECNQGQIILCHYYPPCPQPELAIGTSRHSXTPGFLTILLXQDEIRGLQDFSQRRTNWVKR

SEQ ID NO: 14819 - protein, 85 aa, Lilium sp.
GEIKVEIEDDRVLVISGERKRQEEMYQKTERWMGKLTRKFQLAENANPNAVSAVWRDGELTVTVEKLPEGDVEGLTLTVESPGRR

SEQ ID NO: 14820 - protein, 196 aa, Zea mays
  unsure (1)..(196): unsure at all Xaa locations
MAGQSSYSRLAADEAAAAISADDYDSKKLRLLGYEPQLKRNLSLLSNFSVTFSIVSVLTGITTLYGTGLEFGGPVTMVYGWPIAGAFTIVVGLAMAEICSAYPTSGGLYFWSARLCTERRWGPFASWLTGWFNIVGQWAVTTSVDYSLAQLIQVIILLSTGGNXNGGGYLGSKYEVIPIHAAILLGPRVIHSLPIG

SEQ ID NO: 14821 - protein, 496 aa, Triticum aestivum
  unsure (1)..(496): unsure at all Xaa locations
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWXRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGXERYRSWAPDRQDRFVRRFADALAHPKVSHELRVIWIDFLSKCDKSCGMKVANRLNVKPSM

SEQ ID NO: 14822 - protein, 483 aa, Triticum aestivum
  unsure (1)..(483): unsure at all Xaa locations
MGMEKGKADPAAFSIAEAGFGDRTDIDDDGRERRTGTLVTASAHIITAVIGSGVLSLAWAIAQLGWVIGPAVLVAFSVITWFCSSLLADCYRSPDPVHGKRNYTYGQAVRANLGVXQYRLCSLAQYVNLVGVTIGYTITTAISMGAIGRSNCFHRNGHNAACEASNTTNMIIFAAIQILLSQLPNFHKIWWLSIVAAVMSLAYSSIGLGLSIAKIAGGVHAKTTLTGVTVGVDVSGREKIWRTFQSLGDIAFAYSYSNVLIEIQDTLRSSPAENTVMKKASLIGVSTTTTFYMLCGVLGYAAFGSSAPGNFLTGFGFYEPFWLVDIGNVCIVVHLVGAYQVFCQPIYQFVEGWARSRWPDSAFLHAERVLRLPAVLGGGEVPVSPFRLVWRTAYVVLTAVVAMLFPFFNDFLGLIGAVSFWPLTVYFPVEMYMAQAKVRRFSPTWTWMNVLSVACLVVSVLAAAGSVQGLIKDVAGYKPFKVS

SEQ ID NO: 14823 - protein, 590 aa, Olea europaea
IEGPSTMFGSVLNYVTLRLLGEEANDGDGAMEKGQKWILDHGGATAITSWGKMWLSVLGVFEWSGNNPLPPEIWLIPYIVPIHPGRMWCHCRMVYLPMSYLYGKRFVGPITPIVLSLRKELYTIPYHEIDWNVARNQCAKEDLYYPHPLIQDILWASLHKLLEPILMRWPGKKLREKALRTVIEHIHYEDENTRYICIGPVNKVLNMLCCWVEDPNSEAFKLHLPRVYDYLWLAEDGMKMQGYNGSQLWDTAFTVQAILSTKLGEEFGPTLRKAHTYIKNSQVLEDCPGDISSWYRHISKGAWPFSTADHGWPISDCTAEGLKAVLLLSKLPTAIVGEPLDARRLYDAVNVILSLQNDGGGFATYELTRSYSWMELINPAETFGDIVIDYPYVECTSASIQALAAFKNLYPWHRREEVECCIEKAAKFIEKIQAKDGSWYGSWGVCFTYGTWFGILGLLAAGRNFNNCSSISKACDFLLSKQLPSGGWGESYLSCQNKVYSNIVGNTSHVVNTGWAVLALIAAGQAERDPAPLHRAAKLLINSQCENGDFPQEEIMGVFNKNCMITYAAYRNVFPILALGEYRNRVLKTP

SEQ ID NO: 14824 - protein, 123 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 14825 - protein, 380 aa, Arabidopsis thaliana
MGSNEEGNPTNNSDKPSQAAAPEQSNVHVYHHDWAAMQAYYGPRVGIPQYYNSNLAPGHAPPPYMWASPSVLILNLLNPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQRYIESNVVLISTSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 14826 - protein, 495 aa, Leptospira interrogans serovar lai str. 56601
MDLIYRSIYKRRKIMSRKTLTTAGGHPVSQNQHSLTAGPRGPVLIQDTHLIEKLAHFNRERIPERVVHAKGAGAYGTLTITQDLTKYSRASIFSKKGKQTSLFLRFSTVAGEKGSADTERDPRGFAVKFYTDEGIWDLVGNNTPVFFARDPLKFPDFIHSQKRDPVTGYKNPIRMWDYWAGSPEAFHQITILFGDRGIPDGYRFMNGYGSHTFGLWNSKGERFWTKFHFKSMQGIRNLSMEKASALAGTDPDYATRDLFEAIERKEFPKWKFCVQIMPEKEATKYKFNPFDLTKVWSHKDYPLIEVGVLELNSNPKNYFEEVEQAAFSPSNMPPGIGASPDKMLQGRLFAYPDAHRYRLGIQYQQLPVNRPKNSVNVYHRDGRTRFQCDGNYDNYEPNGFEGPVQDSSYAEPPLSISGDMDRYNSHIGNDDYSQAGDLYRLMSVEERERLTSAIASTMHNLPKPLLEANLKHFHLCDPEYGEQLAAKVGLALSRV

SEQ ID NO: 14827 - protein, 514 aa, Arabidopsis thaliana
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 14828 - protein, 327 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTI

SEQ ID NO: 14829 - protein, 592 aa, Vibrio vulnificus CMCP6
MRNTITLPLLGFAAYSGTGKTTLLEALLPKLTAAGLRIGLLKHAHHDFDVDKPGKDSYRLRKAGASQMLIASRNRFALMTETPEAESEFDYLLSRFDQQTIDVILVEGCKNIAFPKIELHREEVGKPWLYPNDENIIAIASDSGPLESALPQLNINDLDAICQFVLDYVHQHQQVATQNAPAACCDTLSPAFLSVAQGQEKILSLVSTVGDIESCPIQHTYGRVLAHDVISPVNVPQYTNSAMDGYAIRSDDLQRESYQIVAEVLAGYHYEHLLELGQAVKIMTGAPTPINGDTVVMREQAHQDGDKVTFNGANIKAGQNVRQAGEDLTIGSSVFTAGTRLASPEMGMMASLGFAQANVLRKLKVAVFSTGDEVQAPGTEQKANSIYDSNRFTIMGMLEKLGCDILDFGILEDNEQSMIDALESAAQQADVVITSGGVSVGDADYIKLALDKLGQIDFWRINMRPGRPLAFGQINEKPFFGLPGNPVAVMVSFINFVEPAVRKMQGELGWKPLKVSAIAKEDLRSRQGRTEFSRGVYELDETGRLTVRTTGKQGSGILRSMSEANCLIEISPAVDSVKTGESVTIIPLQGRI

SEQ ID NO: 14830 - protein, 365 aa, Neisseria meningitidis MC58
MKSVRSFIRDDIQAMSAYQIADVPPGFAKLDSMESPVHPFAGHETLLQEWQARLAAAPIHLYPNPSGSGLQEALRSAFDIPDCADIALGNGSDELIQFITMLTAKPGAAMLAAEPSFVMYRHNAALYGMDYVGVPLNGDFTLNLPAVLEAVRKHRPALTFIAYPNNPTGVCFTRAEIEAVIEASDGIVVVDEAYGAFNGDSFLPQAGRIPNLIVLRTLSKIGFAGLRIGYAAGCPEVIGELQKILPPYNMNQLSLTTAKLALRHYGIISANIDSLKNERERMFAELGKICRLNTFSSQANFITIRVPDADLLFDTLKQNRILVKKLHGAHPLLEHCLRITVGSPAQNDAVLNIIRQLYCQPTDFL

SEQ ID NO: 14831 - protein, 474 aa, Oryza sativa
MAQQLSAPFRAAAAAGSRASAAAADPAKVSPSLPFLLCSLSLTFFPTPPPEFSGLFRVGVRLAEGWDVFVRCVTSCVADTAPRFRLKLGFRESGNLGLGGGGANAGVRFLFIARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 14832 - protein, 293 aa, Streptomyces coelicolor A3(2)
MQIGLVGLGKMGGNMRERLRNAGHTVVGYDTNPDRADVDSLVELVDRLERPRAVWVMVPAGGATQHVIDQLATLLKPGDTVIDGGNSRWTDDEKHAEELGKRGINFVDAGVSGGVWGLKNGYALMVGGDKETVDDLKPVFDALKPDGPYGYVHAGKVGAGHFSKMVHNGIEYAMMQAYAEGWELLEKVDSVDNVREVFRSWQEGTVIRSWLLDLAVNALDDDHHLEKLRGYADDSGEGRWTVEAAIDNAVPLPAITASLFARFASRQEDSPQMKMVAALRNQFGGHAVESAKK

SEQ ID NO: 14833 - protein, 250 aa, Zea mays
  unsure (1)..(250): unsure at all Xaa locations
YVRSSTVQGPRGSADTGRDVLCFVLKFYTEEGNYDLVGNNMPVFFIQDAIKLPDFVHAVKPEAPNEMPTGAXAHDTFWDFVSLVPETTHTELWLMSDRALPASYRAMDSLGVHTYRFVNAAGAEHFVXFHWRPESGAYSLLWDEAQCIARHDPDFDQLDLWMAIERGGYQELEHGEQLIDPSDASKFDFDMLDPSKLVPPELVPVXPIGRMMLCRNPGILFAQTEQVAFHPAHVVPGLDVPNDPRLQVEL

SEQ ID NO: 14834 - protein, 309 aa, Streptococcus pneumoniae
GFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHNVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEM

SEQ ID NO: 14835 - protein, 414 aa, Pseudomonas fluorescens
QVPAASKPWPALHAPRTLPAPHDLDKLVELLSQSKAVTLLCGSGCAGAHDQVVALADALGAPVVHALRGKEHVEWDNPFDVGMTGLIGFSSGYHAMLNCNTLVMLGTDFPYRQFYPSDACVIQIDRNPQALGRRVPLDLGIAADVGETLAALLPRLPYKGDRRFLEESLKHYAKARQGLDDLAQPSPAGRPIHPQYLTRLLSELADQDAIFTADVGTPTVWAARYLKMNGQRRLLGSFNHGSMANAMPQAMGAQAAFPQRQVISLSGDGGFSMLMGDFISLAQLKLPVKIVVYDNASLGFVAMEMKSAGYLDTGTDLHNPDFAAMANAMGILGLRVENSEELEGALRTALAHDGPVLVDVVTATQELAMPPAIKLEQAKGFSLYMLKAVMSGRGDEVIELARTNWLKDSWFKIT

SEQ ID NO: 14836 - protein, 96 aa, Zea diploperennis
MGRRACCEKEGVKRGAWTTKEDDALAAYVKAHGEGKWREVPQKAGLRRCGKSCRLRWLNYLRPNIRRGNISCDEEDLIIRLHKLLGNRWSLIAGRL

SEQ ID NO: 14837 - protein, 566 aa, Kluyveromyces lactis
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 14838 - protein, 398 aa, Cucumis sativus
MALQAASLVSPALSIPKEGKSSVCLKDSSLFGISFSDHLKSEFSSSTLRCKRELNQQIGAIRAQTTATESPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLNKSSYPSKRLIIVGSITGNTNTLAGNVPPKANLGDLRGLAGGLNGLKSSMIDGGEFDGAKAYKDSKVCNMLTMQEFHKRYHEETGITFASLYPGCIATTGLFREHIPLFRILFPPFQKFITQGYVSEDEAGKRLAQVVSEPSLTKSGVYWSWNKNSASFENQLSQEASDAEKARKVWELSEKLVGLA

SEQ ID NO: 14839 - protein, 355 aa, Gibberella zeae
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQVIMW

SEQ ID NO: 14840 - protein, 352 aa, Glycine max
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 14841 - protein, 407 aa, Halobacterium sp. NRC-1
MVMTDTVEDVELPYDDSASQQDKLEALEEQLSTLEEENEERDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 14842 - protein, 394 aa, Triticum aestivum
MGLAENHLSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCIEPGWVRCCFTTLREQDIPVVVERLRRVTDGHKSNR

SEQ ID NO: 14843 - protein, 459 aa, Bacillus cereus ATCC 14579
MNEKYDKHRKELLEEDFNKHRELTEPAKFHSQTVGSRGPVLEQDSVLHESLQQFIHEKILERPVHVKGFGAFGYFQTIYSMSEHTKLSFLQNSNEKVPVMVRFSLAVSTKGTPDTARNVRGFSTKFYTKEGIFDLLCNHIPVFSVRDPMRFPETIQALLPSPKNNLIDPNRFWSFVAKAPESIHFVVRLYSNNGTAKSLRHIPGHSVNTYVWRNAEGNRKYVKYHWYPFEGVQYITSKEAIKLAAENPDYSGKDLYDAIENGKPVEYGLYVQLMDPKDETHLSYDPLDDTKVWDEQTYPLIPVGKMVLNKNPENFMEQVEKVAFSPSNLLEGAELSDDKMLQGRANIYSDSQRRRIGPEFRKLTINQQQDWTPANQITTGEGRYVEGKLERASITKQDDFTQAGEFYTKLQPIEKEHLAENLASDLKVISDDIREIVLGYFNQVSTDLKTSIETKMKEH

SEQ ID NO: 14844 - protein, 225 aa, Glycine max
MSSTTVVGSISTTAALTPLLPSSRTSRSTFGANSTSTSFPATPLSSNLLFFKLNHTSSSSSKRTSTFHGFKRFSPVMEWQDCTVKMEIDVPISVAYTCYSDREAIPNWMPFISSVKILPDKPDLSRWSLKYKAFGRDIEFSWLARNMQPIPNQKIHWRSMEGLQNIIRGAVRFYPKGPSSCVVELTVSYEVPQLLAPVASALQPFLEGLLQRGLERFAKFAKSYT

SEQ ID NO: 14845 - protein, 276 aa, Zea mays
MALYAFAAVWLCWVMWGYQMSFGQKLLPFWGKAGHTLGQGFLLSQAGLPATTHFFHGSGVVETGEITPLYPMASMVYFQCVFAAITLILLAGSLLGRMNFKAWMLFVPLWLTFSYTIGAFSIWGGGFLFHWGVIDYSGGYVIHLSSGVAGFTAAYWVGPRLTKDRERFPPNNVLLMLTGAGILWMGWAGFNGGDPYAANIDSSIAVVNTNICAATSLLVWTCLDVIFFKKPSVIGAVQGMITGLVCITPGAGLVQGWAAIVMGMLSGSIPWCTMMV

SEQ ID NO: 14846 - protein, 386 aa, Corynebacterium efficiens YS-314
MSENNAQDTRIDFLYLNEEDMVAAGVTDSARCVETMEETLILLADGDYRMAGASANSHGAQINFPENPEHEGMPADGPDRRFMAMPAYLGGRFRSTGVKWYGSNTENRKKDLPRSIHVFVLNDADTGAPKAIMSANLLSAYRTGAVPGVGVKHLALEDSKTVGIIGPGVMSRTIFDAALSQRPSIEEVKIKGRSPESTQRVAEWFREKYPQLRDVRIVDSEQEAIEGSDIVISGTSTSPDGPSGFPYFKREWIKPGALLLMPAAARLDDDFTTSDEANLVVDYRGLYSEWFHENGPNVTYEDLLGIPGNRWYDMFKEGLIPEEKMVNIGDIASGKAPGRQNDEQIFCYSIGGMPVEDVAWAHDLYENAVKKGIGTELNLWDTPILK

SEQ ID NO: 14847 - protein, 335 aa, Streptomyces avermitilis MA-4680
MTIRVGINGFGRIGRNYFRALLEQGADIEIVAVNDLGDTATTAHLLKYDTILGRLKAEVTHTADTITVDGKTIKVFSERNPADIPWGELNVDIVIESTGIFTKKADAEKHIAGGAKKVLISAPASDEDITIVLGVNEDKYDPAKHNVISNASCTTNCVAPMAKVLDENFGIVKGLMTTIHAYTNDQRILDFPHKDLRRARAAAENIIPTTTGAAKATALVLPQLKGKMDGISMRVPVPTGSATDLVVEVSREVTKDEVNAAFKKAAEGELQGYLSYTEDPIVSSDIVGDPSSCTFDSAMTMVMEGTSVKILGWYDNEWGYSNRLVDLTVFVGNQL

SEQ ID NO: 14848 - protein, 356 aa, GIBBERELLA ZEAE PH-1
MSFRTLRIGLIPGDGIGKEVIPAGRRILEALPSSLGLKFDFVNLKAGFETFEQTGAALPDKTVEVLKNECDGALFGAVSSPTQAVKGYSSPIVALRKRLDLYANVRPVKTVMTAAKPIDMVIVRENTEDLYVKQEKTYDTPEGKVAEAIKRISEKASFRIAAMAGDIALRRQKIRDAGASSIHKSPLVTITHKSNVLSQTDGLFRATSKRALADPKFSSVAVEEQIVDSMVYKLFRQPEDYDVIVAPNLYGDILSDGAAALVGSLGLVPSANVGEGFAIGEPCHGSAPDIQGQNIANPIATLRSTALMLEFLNEEEAAAKIYAAVDGNLEDGKLLSPDLGGKATTEEVVADILRRL

SEQ ID NO: 14849 - protein, 210 aa, Azorhizobium caulinodans
MKGIILAGGSGTRLHPITLVVSKQLLPVYDKPMIYYPLCTLMMAGIRDILIITTPHDSELFQKLLKDGSQFGLNISYAVQPSPRGLADAFIVGREFVGNDRVALVLGDNLFFGHGLPELLKTAQARETGATVFGYPVTDPERYGVVEMDETGKVLSLEEKPLKPKSNLAVTGLYFYDNRVVDIAANLAPSPRGEIEITDVNKAYLDLGEL

SEQ ID NO: 14850 - protein, 456 aa, Bonnemaisonia asparagoides
YVIKETDVLALFRITPQPGVDPVEASAAVAGESSTATWTVVWTDLLTACDLYRAKAYKVDAVPNTSDQYFAYISYDIDLFEEGSIANLTASIIGNVFGFKAVKALRLEDMRLPVAYLKTFQGPATGIVVERERMDKFGRPFLGATVKPKLGLSGKNYGRVVYEGLKGGLDFLKDDENINSQPFMRWNERYLYSIEGVNRAVAASGEVKGHYLNVTAATMEEMYERAAFAKQLGSIIIMIDLVIGYTAIQTMAIWARKNDLILHLHRAGNSTYSRQKIHGMNFRVICKWMRMAGVDHIHAGTVVGKLEGDPLMIRGFYNTLLQSKLDINLPQGIFFEQDWASLRKVTPVASGGIHCGQMHQLLDYLGVDVVLQFGGGTIGHPDGIQAGATANRVALESIVIARNEGRDYVEEGPQILRDAAKTCGPLQTALDLWKDITFNYTSTDTADFVETPTANV

SEQ ID NO: 14851 - protein, 369 aa, Streptomyces avermitilis MA-4680
MIASNGEGPHRQTHVDPLAAVRAPGDPPWDVYLTGPVFLDIIFTGLDSAPVRGTESWARGMGSSPGGVANMATALARLGLKTSLAAAFGDDHYGEYCWDALAQGEGIDLSPSRTVPGWHSPVTVSMAYEGERTMVSHGHEPPPEETAPDCPPRARAAVASLAPGSRAPWIAQAASEGTRIFADVGWDDTGRWDLAGLADLGHCEAFLPNADEAMRYTGADCPRAAAHALTEHVPLAVVTLGADGAYAVDRRTGEAAEVPAIAVEAMDPTGAGDVFVAGFVTGTLAGWPLADRLAFAGLIAALSVQEFGGSLSAPGWSEIAAWWRRVQSYDDQDPTALRRYAFLEGLIPEVTRPWPLRRAVPTIGFGRSA

SEQ ID NO: 14852 - protein, 845 aa, Arabidopsis thaliana
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPYWLTLTTSVTLVPEIVALKTIAAYRSGLDIDTYVSKEVAENGLVEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVYLDFGLAVPKLSVHGMVSSVKELLDLASIKKVMFSTDGYASPETYYLGAKKAREVIFLVLSDACASGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 14853 - protein, 478 aa, Curdiea crassa
  unsure (1)..(478): unsure at all Xaa locations
ELTERYESGVIPYAKMGYWDPDYAVKDTDVLALFRGSPQPGVDPVEASAAVAGESSTATWTVVWTDLLTACDLYRAKAYKVDAVPNAPDQYFAYIAYDIDLFEEGSIANLTASIIGNVFGFKAVKALRLEDMRIPVAYLKTFQGPATGLVVERERMDKFGRPFLGAXVKPKLGLSGKNYGRVVYEGLKGGLDFLKDDENINSQPFMRWKERFLYSMEGVNRSIAASGEMKGHYMNVTAATMEDMYERAEFAKQLGTVIVMIDLVIGYTAIQSMAIWARKNDMILHLHRAGNSTYSRQKSHGMNFRVICKWMRMAGVDHIHAGTVVGKLEGDPLMIRGFYNTLLMTHLDINLTQGIFFEQDWASLRKVTPVASGGIHCGQMHQLLDYLGNDVVLQFGGGTIGHPDGIQAGATANRVALEAMVMARNEGLNYVQEGPQILRDAAKTCGPLQTALDLWKDITFNYTSTDTADFVETPTANV

SEQ ID NO: 14854 - protein, 488 aa, Vaucheria medusa
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAASGEVKGSYLNTTAGTMEEMYERAEYAKSIGSVIVMIDLVIGYTAIQSMSIWARKADMILHLHRAGNSTYARQKNHGINFRVICKWMRMAGVDHIHAGTVVGKLEGDPLMVKGFYNTLLLTKLEINLAQGIFFEMDWAALRKVVPVASGGIHCGQLHQLLYYLGDDVVLQFGGGTIGHPDGIQAGATANRVALEAMVLARNEGRDYMNEGPQILRDAAKTCGPLKTALDLWKDITFDYTSTDTPDFVETATQSR

SEQ ID NO: 14855 - protein, 177 aa, Glycine max
  unsure (1)..(177): unsure at all Xaa locations
ALSMISSSAVTTVYRACAGMVAPFTVLKSMAGFPTRKTNNDITSIANNGGRVHCMHVWPPSVKKKFDTLFFLPHLADAQLANGSEYLPMMGWISCLQFKLEHGSVYREHNRSPGYYYGLYCTMSKLPIFACTDASHASKDLLEAXTVFPDGFLRIIRFHNVRQEHCIIFISYNRSCF

SEQ ID NO: 14856 - protein, 686 aa, Vibrio parahaemolyticus RIMD 2210633
MKLNLITTTLLLASASAIAEPNITISTTTNSRDFPLSAEQPLVVPLTKDGYTLKITGVEGDCVAPDGQKVKFNKPIALNCGKPTELPLKVRFTGDYSFAYDDAAKTLLFKREPKKAAKTEFKRPIPQVQCEVYQGGEVTIAVGDSFPEGTKLRDAYSGQMVEVKEQKVSLTPSKDSGGLVLLEPVQKTKEAVLFDYRNANIYFVMVDRFNNADASNDNSYGRKKDGKDEVGTFHGGDLKGVIEKLDYIKSLGTDAIWLSPIVEQVHGFVGGGDSGSFPFYAYHGYWTRDFTKIDENFGNEEDLKTLVEEAHKRGLKVLMDAVINHSGYSTLADLQFDGIDVLKPNAELPKKWGDWQPKAGENWHSYHQNIDYQSLNWAKWWGGDWVRTGLPGYPAPGSSDITMSLAGLPDFITELDKAVKPAQWLLDNPGTRVEARDNYTVSDYLIEWQTDWVKRFGIDGYRVDTVKHVEGEVWKRLKEEASNSLEQWRKENGKSGQPFWMMGEVWGHTAYRSPYFDDGFDALINFDMQKKLDKGAACFSQMADTYQSYADTIANEKDFNPVSYMSSHDTELFFSRFKDYGMQRNAANALLLSPGAVQVYYGDEVGRNIGPYADDFHQGTRSDMVWKLSDDKQALLKHWQTLGQFRQAHPAIGAGQHRVIEQEGAYVFSRSLGNDKVVVAFVGRDK

SEQ ID NO: 14857 - protein, 756 aa, Zea mays
MWRLKIGERPSNPLLRSPNGFLGREVWEFDPAAGTPEERAEVDRLRQEYTRNRFTRRQCSDLLMRMQYAKQNLHNTNLPAIKIDQDSDVTEETILITLRRALNQYSSLQGPAGHWPGDYGGISFILPLMIFALHVTRSMDEVLSIEHIREICRYIYNMQNEDGGWGTHTLGPSSMFGTCVNYATLRILGEVLDGENDALSKGRSWILSHGSATAAPQWAKIYLSMIGVYDWAGNNAIIPELWMLPHFLPIHPGRFWCFCRMVYMPMAYIYGKKFVGPITTTILEIRNELYNIPYNKINWNKACNSCAKEDLIYEPSWLQSIAMAYLNKFIEPLSNLWPMNKLRERAMSDLMEHIHYEDETSNYVGLCPINKALNMICCWIEKPNSNEFRQHLPRIHDFLWLGEDGMKSKVYVGCHSWETALIVQAFCSTGLTEEFCSTLQKAHQFLKNAQVIENIPDYKSYYRERTKGSWTLSNGENFWPIADTTAEALKAILLLSNIPSELVGDPIKQERLYDAVDCLLSFVNKDGTLSSAECKRTTSWVEFINPSESFRNIIVDYPYPECTSSLIQALVLFRGKHPIYRRDEIDKIIKSGASFIEKVQRKDGSWYGSWAVCFTYATFFAIKGLVAAGRTYRNSLAIRKACNFLLSKQLGTGGWGENYLGCQIEEYVDSGSPHGVNTAQAMLALLYAGQVEQDPAPLYRAAKELINMQMENGEFPQQEIVGNFNSSLFFNYPNYRNLFPIWALGEFRRRLVAKKG

SEQ ID NO: 14858 - protein, 429 aa, Glycine max
  unsure (1)..(429): unsure at all Xaa locations
VHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLAPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAETFPIPPAICSGRREKXGIEKENNFKQPGERYRSWAPDRQDRFNRRWVDALSDPRVTHEIRSVWISYWSQADRSLGQKIASRLSMRPNI

SEQ ID NO: 14859 - protein, 105 aa, Triticum aestivum
SRPRYAAWSTGDTVKSKEPVPLWQIVVIALTICFGFCTYGYNIMRVMGNKITYHSPSRGSSMEMGAAITILIFSQYKLPVSTSMCITGATVGVGLCNGTCPGGRS

SEQ ID NO: 14860 - protein, 392 aa, Oryza sativa (indica cultivar-group); identical to SEQ ID NO: 8204

SEQ ID NO: 14861 - protein, 342 aa, Trichodesmium erythraeum IMS101
MPLKVAINGFGRIGRLVFRAGLNYPDLIEFVGINDLVPPQNLAYLLKYDSTHGRFQGEVTASDDGIKINGKLIPCVSVKNPAELPWKEKDAHYVVESTGLFTTFDSASNHLAAGAKRVIISAPTKDPDKVKTLLMGVNHDLFDPAVDTIVSNASCTTNCLAPIAKVIDDNFGLTEGLMTTVHAMTATQPTVDGPSKKDFRGGRSAAQNIIPAATGAAKAVTLVLPHLKGKLTGMAFRVPTPDVSVVDLTFKTEKSTNYKDICAAMKTAAENSMKGILSYTEDPVVSTDFTGNSHSSIFDAGAGIELNSNFFKVVSWYDNEWGYSNRVLDLMLSMAEKEGKPK

SEQ ID NO: 14862 - protein, 186 aa, Brassica rapa subsp. pekinensis
YIGLKQRRATGQEYAEFLHEFMCAVKQNYGEKVLVQFEDFANHNAFDLLSRYMDSHLVFNDDIQGTASVVLAGLIAAQKVLGKSLADHTFLFLGAGEAGTGIAELIALKISKETGAPIEETRKKIWLVDSKGLIVSSRKESLQHFKQPWAHEYEPVKDLIGAVNAIKPTVLIGTSGVGQTFTKEVV

SEQ ID NO: 14863 - protein, 209 aa, Nicotiana tabacum
MGSSSGSDVEAGFAKLQGEDFEYYMQTYSIILGRNSKKSTVDVDLSSLGGGMNISRHHARIFYDFQRRRFNLEVLGKNGCFVEGVLHLPGNPPIKLDSQDLLQIGDKEFYFLLPVRSILGGGPPIGPKQNVNYPVAAHYGGIGKKGGLFRGREREYYDEEEYDDDDDDDDGTGGKKMRRCDGAEGGGGYGGYGSCGSSGKASISGQLGQ

SEQ ID NO: 14864 - protein, 176 aa, Triticum aestivum
  unsure (1)..(176): unsure at all Xaa locations
MAPTVMASSATSVAPFQGLKSTAGLPVSRRSNGSCLGSVSNGGRIRCMQVWXPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 14865 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 14866 - protein, 335 aa, Triticum aestivum
  unsure (1)..(335): unsure at all Xaa locations
AGRFGNNASVIFLDQPVNVGYSYSGGSVSNTVAAGKDIYALLTLFFHQFPEYAKQDFHIAGESYAGHYIPVFANEILSHDDRNINLKSVLIGNGLTDGYTQYAYYRPMACGDGGYPSVLSESECQSMDNALPRCQSLIKGCYESGSAWSCVPASIYCNNAMMGPYQRTGQNVYDIRGKCEDGNNLCYSGLGYIADYLNREEVKEALGAEVSSYDSCNMDINRNFLFAGDWMQPYHQLVPNVLDKIPVLIYAGDADFICNWLGNQAWTDKLQWSGQKDFSHADLKPLKHAGKEYGKVKSSGNFTFMQIYGAGHMVPMDQPEASSDFXHRWLSGEWF

SEQ ID NO: 14867 - protein, 306 aa, Salmonella typhimurium LT2
MRFRQLLPLFGALFALYIIWGSTYFVIRIGVESWPPLMMAGVRFLSAGMLLMAFLLLRGEKLPPLRQTINAALIGLLLLAVGNGLVTVAEHQNVPSGIAAVVVATVPLFTLCFSYFFGIKTRKLEWVGIAIGLAGIILLNSGGNLSGNPWGAILILIGSMSWAFGSVYGSRIALPVGMMAGAIEMLAAGVVLLCAAFLSGEKLATLPGLSGFMAVGYLALFGSIIAINAYMYLIRNVSPALATSYAYVNPVVAVLLGTGLGGERLSPVEWAALGVIVFAVVLVTLGKYLFPVKAVVTPCKTEDSRQ

SEQ ID NO: 14868 - protein, 348 aa, Saccharomyces pastorianus
MSIPKTQKGVIFYESHGKLEYKDIPVPKPKANELLINVKYSGVCHTDLHAWHGDWPLPTKLPLVGGHEGAGVVVAMGENVKGWNIGDFAGIKWLNGSCMACEYCELGNESNCPHADLSGYTHDGSFQQYATADAVQAAHVAPGTDLAEVAPVLCAGITVYKALKSANLMAGHWVAISGAAGGLGSLAVQYAKAMGYRVIGIDGGEGKEELFRSIGGEVFVDFTKEKDIVGAVLKATNGGAHGVINVSVSEAAIEASTRYVRANGTTVLVGMPANAKCCSDVFNQVVKSISIVGSYVGNRADTREALDFFSRGLVKSPIKVVGLSTLPEIYEKMEKGQIVGRYVVDTSK

SEQ ID NO: 14869 - protein, 332 aa, Buchnera aphidicola str. Sg (Schizaphis graminum)
MTIKIGINGFGRIGRVLFRLAQERENIEVVAINDLLDPKYIAYMLKYDSTHGNFKKDIEVKNNNLIINGKKIRITSIKDPEKLMWDKLLIDVVIESTGLFLTKDTAYKHILSGAKKVVITGPSKDDIPMFVRGANFDKYKGEKIVSNASCTTNCLAPLSKVIDDHFGIIEGLMTTVHASTATQKIVDSASKKDWRGGRGALQNIIPSSTGAAVAVGKVLPNLNGKLTGIAFRVPTANVSVVDLTVRYKKTATYNEICEVVKNASEQKMKGILGYTEDEVVSTDFNGKELTSIFDAKAGLSLNKNFAKLISWYDNETGYSSKVLDLVELVALK

SEQ ID NO: 14870 - protein, 448 aa, Oenococcus oeni MCW
MSLIASIYAREVLDSRGNPTVEAEVYSEDGFFGRGIVPSGASTGEHEAVELRDGDKSRYLGKGVTKAVANVNGAIAEALIGKFDVADQRGIDLAMIALDGTPNKGKLGANAILSVSIATARAAAEEAGLPLYQYLGGPNSYVLPTPMMNVINGGVHSDNKVDFQEFMIMPVGAKTVKEAIRMGSETFHNLKKLLEADGKNTSVGDEGGFAPDFANNEEPLQYLVKAIQAAGYKPGKDIALATDVAASELYDADTKKYKLKWSTGEEFTAPEFEKYIEGLVAKYPIVSVEDPLDENEWDDWVEVTKELGKKVQIVGDDFFVTNTDYLKRGIEMGAANAILIKLNQIGTLTETFEAIEMAKEAGYTAIVSHRSGETEDTTIADLVVATNAGQIKTGSMSRTDRIAKYNQLMRIEDELNQGEPEGVSIYKGINSFYNLNADAKKEIQSHQG

SEQ ID NO: 14871 - protein, 243 aa, Zea mays subsp. parviglumis
SIRNNPVQNKLMNSEDPINNNHAQTAGSLGVRLATSSSSRDPSPSDEDMDGEVEILGFKMPTEERMRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPPPLIRDSIVGYFSATAADDDASVGNGFLRLQAHQEPASMVVGGTLSATEMNRVAAATHCAGAMELIQTAMG

SEQ ID NO: 14872 - protein, 186 aa, Triticum aestivum
  unsure (1)..(186): unsure at all Xaa locations
LPPQQAPPDRKGRGGAGGGVMESGSRSSGAAGFDDDDGLTTRREVSSSLQDLTVRVDRKGGSCSDGGTDQRPNTPRSKHSATEQRRRSKINDRFQXLXELLPHSDQKRDKATFLLEVIEYIRFLQXEKVQKYXATFQEWDQENAKDASWVIAFKLQCLVLLLQGKINSDCRECNISSIVFHYRKIQ

SEQ ID NO: 14873 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 14874 - protein, 480 aa, Nostoc punctiforme
MLKKVVMIGAMTLLFLAGPLMGNAFAQTPVAVPAADTGDTAFMLISAALVLLMTPGLAFFYGGFVRSRNILNTLMMSFVLMAIVGVTWILWGYSLSFAPGLPFIGGLQWFGLNGVGLETQGYLPHLPYEDALKAADPKYADVVSYAGTIPHQAFTIYQAMFAIITPALISGALVERMSFRAYSLFVLLWSTFVYAPLAHMVWAKGGFLGLAGGLGALDFAGGTVVHISSGVSALVAAIVLGPRKTHPDRLSPPHNVPFILLGAGLLWFGWFGFNAGSALSVASGTSGNLTTNLATTAFVATNTAAAAAALMWLILEAVLRGKPTAVGAATGAVAGLVGITPAAGFVTPLSAILIGFITAFVCFYAVSFKHKLQIDDALDTYPVHGVGGTVGAILTAIFATTQVNGGGKDGVLRGNFGELGVELIAIAVAYAIAGVGTWIILKVIDATVGLRVKEEAELQGLDINEHGEEGYNSEFGDRPT

SEQ ID NO: 14875 - protein, 601 aa, Glycine max
  unsure (1)..(601): unsure at all Xaa locations
MWKVVRYAAARSRRFSTAIPGPCKVHKRGTDILHDPWFNKDTGFPLTEREXLGLRCLIPPRVISFEQQYDRFMNSYRSLENNTQGQSDRVVSLSKWRXILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDRLYLGLRQPRLEGEEYLSIVDEFMEAVHARWPKAIVQFEDFQMKWAFETLKRYRKRFCMFNDDIQGTAGVALAGLLGTVRSQGQPLTDFVKQKIVVVGAGSAGLGVLSMAVQAVSRMSGGSGTDANSQFFLIDKDGLVTTERSNLDPAAVPFAKNPRDLEGLSEGASIIEVVKKVKPHVLLGLSGVGGVFNTEVLKXLYPSVDSIRAVTAKVGAAMLRAAVAIEAFSHAGENIVFASGSPFENVDLGNGEVGHVNQANNMYLFPGIGLGTLLSVFCHTSDRIVSAAADCLASYMTDADVRRGILYPSIDCIRDVTAEVGAAVVCAAVAEKQAEGHGDVGFKELENMSKEETVEYVRGNMWYPEYCPLVHEK

SEQ ID NO: 14876 - protein, 404 aa, Tropheryma whipplei str. Twist
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRITGRMIHSSFELAELVLSETLVATVPGEAFGTKGHLRLSYALDETSLLEGTGRLVEFFDTANSDMTKVF

SEQ ID NO: 14877 - protein, 240 aa, Zea mays
  unsure (1)..(240): unsure at all Xaa locations
YDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAXRCAHHNNHYDGAMNFMHRDEEVDYYPSRHAPLRQAAPPTPXLPPRPVAGRREKATIRKPNDFKQPGERYXRPGHADRQDRFVRRFADSLGHPKVSQELRSIWIDLLAKCDASLGMKIATRLNMKANM

SEQ ID NO: 14878 - protein, 223 aa, Zea mays
MTWNRSAADGGGSSAGTTAGDDTGLARLRELGYKQELKRDLSVLSNFAFSFSIISVLTGITTLYNTGLNFGGPATMTFGWFVAGAFTMAVGASMAEICSSFPTSGGLYYWSARLSGKRWAPFASWITGWFNGVGQWAVTTSVDYSLAQLIQVIILLATGGKNGGGYLASKYMVIGFHAAILLSHAVINSLPITFLSFFGQFAAAWNMLGNHSTFFYGGNDGGG

SEQ ID NO: 14879 - protein, 250 aa, Triticum aestivum
MSRRYDSRTTIFSPEGRLYQVEYAMEAIGNAGSALGILAADGVVLVGEKKVTSKLLQSSRSAEKMYKIDSHLACAVAGIMSDANILINTARLHAQRYALSYQEPIPVEQLVQSLCDTKQGYTQFGGLRPFGVSFLFAGWDKNHGFQLYMSDPSGNYGGWKAAAVGANSQAAQSMLKQDYKDGMTREEAVALALKVLSKTMDSTSLTADKLELAEVFVQPGTWEVQYQVCSPDAMGKLLAKAGLTQPAPEA

SEQ ID NO: 14880 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 14881 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 14882 - protein, 253 aa, Glycine max; identical to SEQ ID NO: 2028

SEQ ID NO: 14883 - protein, 178 aa, Zea mays; identical to SEQ ID NO: 3538

SEQ ID NO: 14884 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRFANACGAITTTKKGAIPALPTESEVQSLLKGN

SEQ ID NO: 14885 - protein, 315 aa, Phaseolus vulgaris
MSNFPVINFEKLNGEERKDIMEKIKDACENWGFFELVDHGIPHDLLDTVERLTKEHYEKCMEEKFKESMASKGLEAIQTEVKDMDWESTFHLRHLPESNISEVPDLVDEYRKVMKDFALRLEKLAEQLMDLLCENLGLEKGYLKKAFYGSRGPTLPTKVANYPPCPNPRVVKGLRAHTDAGGIILLFQDDKVSGLQLLKDDQWVDVPPMRHSIVVNIGDQLEVITNGKYKSVEHRVIAQTDGARMSIASFYNPGSDAVIYPAPELLEKEAEEKAQLYPKFVFEDYMKLYADLKFQAKEPRFEAFKESNFDPIATA

SEQ ID NO: 14886 - protein, 476 aa, Aureococcus anophagefferens
SDRYESGVIPYAKMGYWDASYQVKATDLLALFRITPQPGVDPVEAAAAVAGESSTATWTVVWTDLLTACDVYRAKAFRVDPVPSAPDQFFAYIAYEGDLFEEGSLANMTASIIGNVFGFKAVKALRLEDMRIPHSYLKTFQGPATGVVVERERMDKFGRPLLGATVKPKLGLSGKNYGRVVFEGLKGGLDFLKDDENINSQPFMRWRERFIYCVEGINRAAAATGEVKGSYLNITAATMEEMIIRAEYAKELGSIIIMIDLVIGYTAIQTMAIWSRENDMLLHLHRAGNSTYARQKSHGINFRVICKWMRMAGVDHIHAGTVVGKLEGDPLMVQGFYDTLLKTKLAIDLPKGIFFDMDWAALRKCMPVASGGIHCGQMHQLLNYLGDDVILQFGGGTIGHPDGIQAGATANRVALEAMVLARNEGRNYVEEGPQILRDTAKMCGPLQTALDLWKDISFNYASTDTADFAETPTANV

SEQ ID NO: 14887 - protein, 343 aa, Medicago sativa
MMRPSILRSVKSAVSRSITRRGYATEPVPERKVAILGAAGGIGQPLSLLMKLNPLVSTLSLYDIAGTPGVAADVSHINSRSQVTGYAGEDELGKALEGADVVIIPAGVPRKPGMTRDDLFNINAGIVKSLATAISKYCPHALVNMISNPVNSTVPIAAEVFKKAGTYDEKRLFGVTTLDVVRAKTFYAGKANVPVAEVNVPVIGGHAGVTILPLFSQASPQANLDDDVIKALTARTQDGGTEVVTAKAGKGSATLSMAYAGAIFADACLKGLNGVPDVVECSYVQSNLIAELPFFASKVRIGKNGVEEILGLGSLSDFEKQGLENLKSELKSSIEKGIKFASQ

SEQ ID NO: 14888 - protein, 102 aa, Triticum aestivum
  unsure (1)..(102): unsure at all Xaa locations
MAPTVMASSATSVAPFQGLKSTAGLPVXSRRSNGASLGSVSNGGRIRCMQVWPIEGIKKFETLSXLPPAQHGGLLKQVDYLXIRSKWVPCLRXXAXLGFNFR

SEQ ID NO: 14889 - protein, 573 aa, Schizosaccharomyces pombe
MKLNIFKSHGDSNTAEERPVPLEQVEAEDQQHENRFWLGLTAKEFRLMMLAGVGFFLDSYDLFIINLVTPIFEYLYWGGIEKGPNGKGHYPSGIRGLVNAASNIGNIFGQLMFGFMGDFFGRKFVYGKEMIIVIIATILLIAMPKSIHSPLSKMMWVFCWRWLLGVGIGGDYPMSAAITSERSKLNRRGTLISLIFAFQGFGTLAGAIVTIILLGCFEHPLNREGHYRKLEGVWRLQFGLALVPAIGVLIPRLMMEETQKFKNSQQLNSGDNRDPKTSLNFEDDELVKNPSVTKGHPEIHESSENYLSRSNTVENEPENIEKQFESVSAPANRSGFIQYFRQWHHFKHLLGTSVCWFLLDIAFYGVNLNQSVILKNIGFSSGTNEYRTLMKNAIGNLIIAVAGYVPGYWFNVFLVEILGRKWIQLQGFVITGLMFAILAGRWNEISTGGRFACFVIAQLFSNFGPNSTTFIYPAEVFPARVRGTAHGISAALGKCGAILASLLFNFLTSIIGYGNVMWIFCGCMWGGILFTLLLPETKGRDADEIDRVELFYGGDGKVECNSKWKSWYVNGIF

SEQ ID NO: 14890 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLE

SEQ ID NO: 14891 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 14892 - protein, 527 aa, Oryza sativa (japonica cultivar-group)
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFDHLTGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTRVMVNAWAIGRDAARWEEAEVFDPDRFEAKRVEFNGGHFELLPFGSGRRICPGIAMGAANVEFTLANLLHCFDWALPVGMAPEELSMEESGGLVLHRKAPLVLVPTRYIQL

SEQ ID NO: 14893 - protein, 371 aa, Candida boidinii
MLSQVFRRSMINRSSLMTRFQSTFTIPEKQMGVIFETNGGPLEYKEIPVPKPKPTEILINVKYSGVCHTDLHAWKGDWPLPVKLPLVGGHEGAGVVVAKGESVTNFEIGDLAGIKWLNGSCMSCEFCEEGNESNCLDADLSGYTHDGSFQQYATADAIQAAKIPEGTDLAEVAPILCAGVTVYKALKTADLAAGQWVAISGAAGGLGSLAVQYAKAMGLRVLGIDGGAAKKELFHSMGGDVFIDFKEEKDIVKAIQDATNGGPHGVINVSVSEAAISQSCDYVRPTGKVVLVGLPAGAVCKSPVFQHVVKSLEIKGSYVGNRADTREALEFFSRGQVKSPIKIVGLSELPMVYGLMEKGAILGRYVVDTSY

SEQ ID NO: 14894 - protein, 299 aa, Geobacillus stearothermophilus
MKGIVLAGGSGTRLYPLTKAISKQLLPIYDKPMIYYPLSVLMLAGIRDILIISTPEDTPRFEQLLGDGSDLGISLSYAVQPSPDGLAQAFIIGEEFIGNDHVALILGDNIFYGHGFTAMLERAASRKSGATIFGYNVKDPERFGVVEFDKNGKVISIEEKPENPRSTYAVTGLYFYDNRVIDIAKSLQPSARGELEITDVNKAYLELGELHVELLGRGFAWLDTGTHESLLEASLFIETIEKRQSLKVACLEEIAYRKGYISREQLLKLAELLKKNGYGQYLLDIANRVSKEGELIENY

SEQ ID NO: 14895 - protein, 90 aa, Ricinus communis
RESFPVPSAICSGKREKCVIEKENNFKQPGERYRSWPPDRQERSLNRLVGGFSEPRITQELRTIWISYWIQCDKSLGQKLATRLNVKPSI

SEQ ID NO: 14896 - protein, 230 aa, Haemophilus somnus 129PT
WNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDNVSLP

SEQ ID NO: 14897 - protein, 130 aa, Leptospira interrogans serovar lai str. 56601
MTNAVLNEKNHSVTSEETKKERVRILAPRVDIYSDEENIYLLADLPGVEEKDVQVQLEKDQLIISGKTSNKDIQGELRYSEFRTGEYKRTFTLTESVEEDRISAVYKNGVLNLTLPKRKPLTKKIEVRSE

SEQ ID NO: 14898 - protein, 384 aa, Staphylococcus aureus subsp. aureus MW2
MISNKLANIPDSYFGKTMGRKIEHGPLPLINMAVGIPDGPTPQGIIDHFQQALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 14899 - protein, 187 aa, Zea mays
  unsure (1)..(187): unsure at all Xaa locations
NHDGDPPRDRHDQQPRTRRQTTTNADAPEGNDNDALTERPPGPSLREDHHRTDKVGHSTRERIPESVAHARGATAQDDCECTHDETTQTCADIPRAPGARTPKSGRCATAIHERPCPETIRDPXGIAKKLDTRESNGDLLRNNLTVYFIRDGGKFAEENHAIKPNPRPHRQEYRRENDNLAHHPQSL

SEQ ID NO: 14900 - protein, 248 aa, Triticum aestivum
  unsure (1)..(248): unsure at all Xaa locations
MAVESDKVGSDGKVWSFCSMPFWQTTHVSSSSSSTTTTIPTTSSMHHSVHHQSQILQSLDRSTHQPSTTVSSVAKSLLPTRRRLRLDPPNKLYFPYEPGKQVRSAIAIKNTCKSHVAFKFQTTAPKSCYMRPPGGILAPGESIIATVFKFVEPPENNEKPIDQKSRVKFKIMSLKVKGEMDYVPELFDEQRDHVADEQILRVIFLDPERPSPALDKLKRQLAEAEAAXEARKKPPEETGPRGGARYPI

SEQ ID NO: 14901 - protein, 304 aa, Streptococcus pyogenes M1 GAS
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFGILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 14902 - protein, 225 aa, Zea mays
MGRGKEELKRIENKISRQVTFAKRRNGLLKKAYELSVLCDAEVALIIFSSRGRLFEFSTSSCIYKTLERYRSCSFASEASAPLEAELNNYQEYLKLKTRVEFLQTTQRNLLGEDLGPLSVKELEQLENQIEISLKQIRSSKNQQMLDQLFDLKRKEQQLQDANKDLRMKIEETSEENVLRLSSQDIGCSGSSGHGDEANQEHLQLALDPSLHIGYQAYMDHLNND

SEQ ID NO: 14903 - protein, 375 aa, Oryza sativa (japonica cultivar-group)
MEKIQVTTPMADSSFNPEFLQAHAELWNLTFSYLKAMALECAIKLGIPNAIHRCGGSASLSELVISIPVPETRKPHLPRLMRFLAAVGVFSLDNPTIDEEVTEKGMGIYRLTPLSRLLVDGSIGGHGSLSPFVLSQTTKYHVSAAMNLSDWFMTEDKEVAIEMPFRAAHGTDLWGVMSRDANMNEVFNAGMGSDSRLAINFIISKCGEVFEGISSLVDVGGGTGTTARDIAKAFPHIKCSVLDLPNVIDTITVDGIIEYIAGDMMEQIPPTDAVLLKYILHDWNDEDCVKILKQCRNAIHAQKPGGKVIIIDIVVGSPSKDMFEAQVSFDLLMMVITSGKERDQHEWHKIFMDAGFSHYKTRPVLGFLAITELYP

SEQ ID NO: 14904 - protein, 268 aa, ASPERGILLUS NIDULANS FGSC A4
MAGVLFSPEKDIPNLSGKVILITGGTAGLGAAAAIHLAKHSPSHIYISGRNAKSADAVIQQTQKSGTKVSFLACDLASLDSIKKAADTILAQESRLDLLMCNAGIMAVPPGKTSDGYEVQFGTNHLGHALLIQKCLPLLQQTAALPGADVRVVILTSLGFRMHPSAGIVFSDLKSEQNFPAFGSWIRYGQSKLANILYARELARRYPSITSVSVHPGVVGTGLVENLGWAKRTFVYVTNLWKLMKPEEGKLEERAALRAGWDPVVQVG

SEQ ID NO: 14905 - protein, 497 aa, Tuber borchii
MYLNASRKPPSRKGSMHDVPNDLMKHIHDLEKMFTIDTTKLHEVVSVFQEELVKGLSVTGGTIPMNPTWVIGYPTGDETGTYLALDMGGTNLRVCEVELPEEQGQYDIYQSKYRLPEEIKSGTGEQLFDYIAECVKQFLIANHEGQDIKDLKELHLGFTFSYPCEQNAIDHGILQRWTKGFDIEGVEGHDVVPMFEEALERKGVPIKITALVNDTTGTLIASAYTDNTTRIGCIFGTGCNAAYMETIGCIPKLAHMNLDPSLEIAINCEWGAFDNEHRVLPRTVYDKHIDENSPRPGQQTFEKMVAGLYLGEIFRLVLVDLYSNPDVSIFEKQDISTLQAEYSLDASFLAEIESDPWENLMETHALFEKKLKIVTTEPERKLIRRLAELIGTRAARLGACGVAAICKMKNIESCHVGADGSVFNKYPNFQERGAKALREIFGWGRTIRKDPIQIVPSEDGSGVGAALIAALTMKRIRKGIHAGVNVKRKNSLIPPVP

SEQ ID NO: 14906 - protein, 475 aa, Gracilaria tenuistipitata
DRYESGVIPYAKMGYWDPNYVVKDTDVLALFRVSPQPGVDPVEASAAVAGESSTATWTVVWTDLLTACDLYRAKAYKVDAVPNATDQYFAFIAYDIDLFEEGSIANLTASIIGNVFGFKAVKALPLEKMRIPVAYLKTFQGPATGLVVERERMDKFGRPFLGAPVKPKLGLSGKNYGRVVYEGLKGGLDFLKDDENINSQPFMRWKERFLYSMEGVNRSIAASGEVKGHYMNITAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLEINLPQGIFFEQDWASLRKVTPVASGGIHCGQMHQLLDYLGNDVVLQFGGGTIGHPDGIQAGATANRVALEAMVLARNEGRDYVAEGPQILRDAAKTCGPLQTALDLWKDITFNYTSTDTADFVETPTANV

SEQ ID NO: 14907 - protein, 483 aa, Xylella fastidiosa Dixon
MHSNSCHLSDMKNGFFAICIFIVLALLAGGNAIGAEAQVQTNPLPSEQITTELLMSEATPSDAVAIPKTTPTPVVDKGDVAWMLTSTLLVLLMALPGLALFYGGMLRSKNVLSMMVQIGVVFSLIAILWVVYGYSLAFADGDMFIGTFNKAFLYGVDTATLTDTFSKGFKLPEYLYVAFQLTFAGITGVLIVGAFAERVKFAAVLLFIFLWFSFGYLPLAHMVWSTPGFLLSKGALDFAGGTVVHINAGIAGLVGAYFVGKRIGFGQVAVKPHNVPMTFTGAALLWVGWFGFNAGSALEANSIAALAFINTMLATAAAILVWSLLEKMTKGKFSALGVASGMIAGLVGVTPAAGTVGPFGAIAIGAVAAVCCIWGITGLKRLLKVDDTLDVFGVHGIGGIVGAILTGVFTDKALGGQGYAEGMTMSNQVMIQAMGVGISVLWIGIVSLVGFLIVKLLFGLRVSEEAEREGLDITSHGESAYES

SEQ ID NO: 14908 - protein, 388 aa, Salmonella enterica subsp. arizonae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFSGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLK

SEQ ID NO: 14909 - protein, 323 aa, Ipomoea purpurea
MATLTLIFCTLVFAIFLYFLILRVKQRYPLPLPPGPKPWPVLGNLPHLGEKPHQSIAAMAERHGPLMHLRMGFVDVVVAASAAVAAQFLKVHDANFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPILGWFDLQGIVGKMKKLHARFDAFLNSILEEHKFVNNQHTTLSKDVDFLTTLIRLKDNGADTDSEEGKLTDTEIKALLLRRSIWRKLMVSPFNELFL

SEQ ID NO: 14910 - protein, 335 aa, Thermotoga maritima
STFVAGLEKLKKGEIEPYGVPLAGELPIDFKDIRIVGSYDVDRAKIGKKLSEVVSQYWGDVNSLSDDPVVSTGVHLGSVKNLPIEAEGLEDSMTLKEAVERLVDEWSKLDPDVIVNTCTTEAFKPFGNKKELLKAIENNDKERLTATQVYAYAAALYAKKRGGAAFVNVIPTYIANDPAFVELAKENNLVVFGDDGATGATPFTADVLSHLAQRNRYVKDVAQFNIGGNMDFLALTDEGKNKSKEFTKSSIVKDILGYDAPHYIKPTGYLEPLGDKKFIAIHIEYISFNGATDELMINGRINDSPALGGLLVDLVRLGKIALDRKEYGTVYPVNA

SEQ ID NO: 14911 - protein, 75 aa, Glycine max
  unsure (1)..(75): unsure at all Xaa locations
ASSMISSPAXTTVNRAGAGMVAPFTGLKSMACFPTQKTXHDITFIASNRGRMQXLQVLQPICKKNFETFSYFQTL

SEQ ID NO: 14912 - protein, 338 aa, Lactobacillus delbrueckii subsp. bulgaricus
MTVKIGINGFGRIGRLAFRRIMDLGEETKDIEVVAINDLTTPAMLAHLLKYDSTHGTFDHEVSATEDSLVVDGKKYRVYAEPQAQNIPWVKNDGVDFVLECTGFYTSKAKSQAHLDAGAKRVLISAPAGNDLKTIVYSVNQDTLTADDTIVSAGSCTTNSLAPMANALNKEFGIQVGTMTTIHAYTATQKVLDGPDRGNNFRNARAAAENIIPHSTGAAKAIGLVLPELNGKLDGHAQRVPVKDGSETELVTILDKKVTAEEVNAAMKKYESPSFAYNADQIVSTDVLGMTAGSIFDPTQTQVITAGDKQLVKTVAWYDNEYSFTCQMVRTLLHFATL

SEQ ID NO: 14913 - protein, 441 aa, Chlamydia muridarum
MTGKRTKEEQINRQRSHFYRDNVGVIVLCGGEGKRLSPLTCWRCKPTVSFGGRYKLIDVPISHAIASGFSKIFVIGQYLTYTLQQHLFKTYFYHGVMQDQIHLLVPERRDGSQVWYQGTADAIRQNLLYLSDSPVEYFLILSGDQLYNMDFRSIVDYAIDVQADMVIAAQPVSDKDVSRFGVLRVDDEWKLVDFYEKPQSEEILKHFRLSNAAMKKFGLDPQQGNFLGSMGIYLFRKECLFQLLLDETGDDFGKELIHRQMHRGKTVAYLYNGYWTDIGTIASYYEANMALTQRPSQNVRGFNCYDDGGMIYSKNNHLPGAIISDSKISSSLLCEGAMIESGQVSNSVIGVRGVIGQGSIFDHSIMMGSDSYVSGSVPFGVGKNCEIHKTIIDENCCIGNGVRLQNLQGHKDYDSPDGKLVVRDGIIIVPKGTKIPDNYVF

SEQ ID NO: 14914 - protein, 104 aa, Glycine max
MAHTSGNALVQWLVASLLIAMLGGAKAYVLCDIESNKLSLCYAAVTGSHPKKPNEKCCEIVQHANLPCLCRYKSILPALGINPTNAFALPSKCGLKTPPKCKVI

SEQ ID NO: 14915 - protein, 182 aa, Gossypium hirsutum
MASSMISSATIATVNCSSPAQANMVAPFTGLKSASAFPVTRKANNDITSLASNGGRVQCMQVWPPLGKKKFETLSYLPDLTPVQLAKEVDYLLRSKWIPCLEFELEEGFVHRKYSSLPTYYDGRYWTMWKLPMFGCTDSAQVLEELENCKKEYPNAFIRIIGFDNVRQVQCISFIAYKPKGY

SEQ ID NO: 14916 - protein, 332 aa, Salmonella typhimurium LT2
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 14917 - protein, 189 aa, Porphyra purpurea
MILIIDNYDSFTYNLAQCVGELGHDVLVCRNDEIDVVKIKKLNPEKIIISPGPGKPTESGISLDVISSLAEYIPILGVCLGHQSIGYINGGSIIKVPKIMHGKTSQIYHDREDLFINLPNPFIATRYHSLIIDRANFPTNLAVTAWTDNNIIMACRHKHYKMLRGIQFHPESLWTVCGQQLLKNFLDSD

SEQ ID NO: 14918 - protein, 103 aa, Glycine max
  unsure (1)..(103): unsure at all Xaa locations
MASSMISWPGVTTVKRADAGMVASFTGLKSMAGFPTSNTNNDITFIAINGGRRRCTQASPPIGNKKFXTLSYLTDLDNAQXAKEVLFLLTKGLIPCFKFELEH

SEQ ID NO: 14919 - protein, 327 aa, Clostridium perfringens str. 13
MKKIAVIFNGGTISMKVDDRIKAAVPSLTGEEIMAMVTGIESFATIESHSFSSLPSPHITPEIMLELSKFINALVEREDIDGVVVTHGTDTLEETSYFVNLTTKTSKPIVFTGAMRSGSELGYDGPANLAASICTAASDEAKNRGVLVCFNGELNSASEVTKANSMALNAFRTPNFGPIGIVDNNRVIFDRRVPQEDFIPLEVIDKKVAIIKCAAGMDGDFIYHCIEKKYDGIIIEALGRGNVPPTMVDAIKDALDKGIVIVLTSRCFEGRVSDSYGYLGGGKNLKELGVIFGESMPSQKARIKLLTLLGFNKDYRYIKHSFEKERY

SEQ ID NO: 14920 - protein, 1063 aa, GIBBERELLA ZEAE PH-1
MKERDTQNMNGTQIELDSLPTTDSIKHEPPILYGAGNWINGFRRAEPRPGYLPTDAPERFYDLRAANAKTANTALARELKGRHLQMIAFGGSIGTGLFVASGGSLYRGGPASLLLSYVLIGGMQYCTMQSLGELCVAFPIAGSFSAFSTRFLDPSWGFAMGWNYCLQWLFVLPLEIIAGAFTIGYWDETIDRSVFVSVFLLTIVAINLFGVKTYGEAEFIFSIIKITAIVGFILLAIVINIAGEPEGHYIGGMYWRNPGAFKNGFKGFCSVLVTSAFSFTGTELIGLAAAETANPRKSLPTAIKQVFWRIMIFYLVALLLVGLLVPSDDSRLVGGDNVADATASPFVIAIEKAGTSLLPGIMNAIILIAVISVGNSAVFGSSRTLAALAEQSHAPHIFAYVDRQGRPLMAILFASCIGLLAFLADVKYHDAIFNWLLSISALSTLFTWGSICLCYIRFRAAWSHNAHTIEQLPFKSNVGVAGAWVALIGYILVLLSQIWIAASPVYAPDIVDGASGVAQNFFLKVLAIPIILLFYICHKAFVVQYMGDVHMKAMEASYATILWGVALAVVGFLSHRIIAIALRPHSSRFNGLPRPKGQQPFAGHALRILRGGGPNDVYLQWTRQWPDAPFIRCLSWLNEEILLVNSLEACREVLQTNAYFFAKPGFFHTLVGEFLGLGLLFSVGEQHKRLRRIIAGPLSRPSIRKLFPTFVTYSQKLNREIGEALERSKSGIVEIEDLIIRVTLDIIGVSLLGRELRDFRSESSPLSFEQCYNAILAQPLAGQIISFINPFIPLRWLPVSANLNFIRAKSALKTMMEGLIEQRTAEVGAAKLMNEDDKLSDDLLTRMIEASAEESQKLSKEELIDITMQVIAAGHETTASALVWTAYSLAKDPASQQSLRAEIHSLGTEMSAKGIDELPFLDNVIREAMRVHSPTLIIPWEAQKDMTIAGTHIPKGTTVQIVPAMIQLNPEIWGSDADVFRPGRWEDMGGNASSPYAMETFSNGPRMCPGKALALLNMKVLLVGLIRDFEMEIVDDGKEVELRNPSLTLKAKSLIQFKMRKVS

SEQ ID NO: 14921 - protein, 283 aa, Zea mays
MAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTVSEASKPSDDFPEFKLSDAPAPPAENLNGKHEPKSPKSAPRSPKAATHPTFATSVKKPIGAKKVGGKTGGLGVRKLTTKPNESLYEQKPEEPKPAIPALTAPTAKGGPSLHSRFEYVENEPSAAVLLSYLHRITDSSCTATAL

SEQ ID NO: 14922 - protein, 283 aa, Glycine max
FGSRWRGFTLQEFANQLFSNIYDYGKGRQMPAHYGSKKHNYFTVASTIATQISHAVGAAYSLKMDKKDACAVTYFGDGGSSEGDFHAALNFAAVLEAPVIFICRNNGWAISTPISDQFRSDGVVVKGQAYGVRSIRVDGNDALAIYSAIQAARQMAITEERPILIEALTYRVGHHTTSDDSTKYRPANEIEWWRVARDPVVRFRKWIEKHGWWNDMAESELINNLRQQLLHTIQEAEGVEKPPLADSFSDVYDVAPSNLREQEQWLKEIVRKQPQEYPTNISV

SEQ ID NO: 14923 - protein, 323 aa, Azotobacter vinelandii
MFLVCGEALFDLFVDPAQSELPRQVGFKAIAGGSPFNVAVGLSRLGVESALLTGISGDFLGQQLRRVLEDEGVSTRYLVPLDAATTTLSLVAVDGQGVPHYSFYGHSGADRQLRPEQVPALDGGVRGIHVGSYSLVVRPTADSLQQLVERSSRELLISLDPNVRLNVEPDLDVWRERIGAFARHAHLVKVSEEDLLLLYPGQDPLATAEAFLQHQCRLVCLTRGEHGVTVFNRAHGSWSSPAQAIVPVDTVGAGDTFQAALITYLAEQGFDSPAALDALDRSHIERMLAFAQAAAALTCQRRGPDLPRRHELAMPAGQPAPVV

SEQ ID NO: 14924 - protein, 408 aa, Burkholderia fungorum
MSESDLPMPSFPNARDAVRALRPSQIREVANAGFGVDDVLPFWFGESDRVTPAFIRDAASAALAAGATFYTHNLGIAPLRAALAGYVSKLHGATAPEHIAVTSAGVNALMLAAQLVVGAGDRVVAVTPLWPNLVEIPKILGAQVETVALGYGEHGWQLDLEQLLAALTPDTKMLLINSPNNPTGWVMSRDEQRAVLAHCRRHGIWIVADEVYERLYYADADPADPGAPPRTAPSFLDLAARDERVICVNSFSKAWLMTVWRLGWIVAPASLMDDLGKLVEYNTSCAPAFVQHAGIAAIEQGESFARDLVRDLKASRDHLVRALSAVPAVDVKAPPGAMYLFFSMPGASHSLELCKAMVRDVGLGVAPGSAFGPQGEGFVRWCYACDTARLDAGVERLKRFLAHRATAR

SEQ ID NO: 14925 - protein, 146 aa, Triticum aestivum
  unsure (1)..(146): unsure at all Xaa locations
MAQESLRLVCPPVSAHEGRLPRQYTLEGQGAKKDISPPLEWYGVPDGTRSLAVVVQDVDADERVPWTHWVVVNISPEEKGLPEGFSGAGGNANAGGGDGGVXQEGVNDWSQPGXGRGPVPDSHGHRXIQFRLYAXLDDVLSLGQQG

SEQ ID NO: 14926 - protein, 359 aa, Saccharomyces cerevisiae
MGVEQILKRKTGVIVGEDVHNLFTYAKEHKFAIPAINVTSSSTAVAALEAARDSKSPIILQTSNGGAAYFAGKGISNEGQNASIKGAIAAAHYIRSIAPAYGIPVVLHSDHCAKKLLPWFDGMLEADEAYFKEHGEPLFSSHMLDLSEETDEENISTCVKYFKRMAAMDQWLEMEIGITGGEEDGVNNENADKEDLYTKPEQVYNVYKALHPISPNFSIAAAFGNCHGLYAGDIALRPEILAEHQKYTREQVGCKEEKPLFLVFHGGSGSTVQEFHTGIDNGVVKVNLDTDCQYAYLTGIRDYVLNKKDYIMSPVGNPEGPEKPNKKFFDPRVWVREGEKTMGAKITKSLETFRTTNTL

SEQ ID NO: 14927 - protein, 145 aa, SYNECHOCOCCUS SP. WH 8102
MGRWLDHSVTTEVQAPAEDVWAVWSDLEAMPKWMRWIESVKTLDDPDLTDWTLAAQGFRFHWKARITQRVEAQQLHWESVGGLPTKGAVRFYPESAERTLVKLSVSYELPRVLAPLMEPSILGGIVTKELQANLDRFRDLVEKGG

SEQ ID NO: 14928 - protein, 272 aa, GIBBERELLA ZEAE PH-1
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAAGQAEAPKEDAPAAATAEDAPAAPAAAEEPKAE

SEQ ID NO: 14929 - protein, 499 aa, Trifolium repens
SHLRPTPSAISKALRHLPNPPSPRPRLPFIGHLHLLKDKLLHYAPIDLSKKHGPLFSLSFGSMPTVVASTPELFKLFLQTHEATSFNTRFQTSAIRHLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVVTEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSESRPERFLETGAEGEAGPLDLRGQHFQLLPFGSGRRMCPGVSLATSGMATLLASLIQCFDLQVLGPQGQILKGDDAKVSMEERAGLTVPRAHSLVCVPLARIG

SEQ ID NO: 14930 - protein, 402 aa, Spinacia oleracea
MAVCTVYTIPTTTHLGSSFNQNNKQVFFNYKRSSSSNNTLFTTRPSYVITCSQQQTIVIGLAADSGCGKSTFMRRLTSVFGGAAEPPKGGNPDSNTLISDTTTVICLDDFHSLDRNGRKVEKVTALDPKANDFDLMYEQVKALKEGKAVDKPIYNHVSGLLDPPELIQPPKILVIEGLHPMYDARVRELLDFSIYLDISNEVKFAWKIQRDMKERGHSLESIKASIESRKPDFDAYIDPQKQHADVVIEVLPTELIPDDDEGKVLRVRMIQKEGVKFFNPVYLFDEGSTISWIPCGRKLTCSYPGIKFSYGPDTFYGNEVTVVEMDGMFDRLDELIYVESHLSNLSTKFYGEVTQQMLKHQNFPGSNNGTGFFQTIIGLKIRDLFEQLVASRSTATATAAKA

SEQ ID NO: 14931 - protein, 472 aa, Gracilariopsis sp.
  unsure (1)..(472): unsure at all Xaa locations
ESGVIPYAKMGYWDPDYVIKDTDVLALFRVTPQPGVDPVEASAAVAGESSTATWTVVWTDLLTACDLYRAKAYKVEAVPNTTDQYFAFISYDLDLFEEGSIANLTASIIGXXFGFKAVKALRLEDMRIPVAYLKTFQGPATGLVVERERMDKFGRPFLGATVKPKLGLSGKNYGRVVYEGLRGGLDFLKDDENINSQPFMRWKERFLYAMEGVNRAVAATGEVKGHYMNVTAATMEDMYERAEFAKQLGSIIIMIDLVIGYTAIQTMAIWARKNDMILHLHRAGNSTYSRQKSHGMNFRVICKWMRMAGVEPIEEGTVVGKLEGDPLMIRGFYNTLLETNLEINLPQGIFFEQDWASLRKVTPVASGGIHCGQMHQLLDYLGIDVVLQFGGGTIGHPDGIQAGATANRVALESMVMARNEKRDYVAEGPEILRDAAKTCGPLQTALDLWKDITFNYTSTDTADFVETPTANV

SEQ ID NO: 14932 - protein, 447 aa, Zea mays
MGQGTPGGMGKQGGAGDRKPGDAGDKKDKKFEPPAAPSRVGRKQRKQKGAEAAARLPNVAPLSKCRLRLLKLDRVKDYLLMEEEFVAAQERLRPQEDKAEEDRSKVDDLRGTPMSVGSLEEIIDESHAIVSSSVGPEYYVSILSFVDKDQLEPGCSILMHNKVLSVVGILQDEVDPMVSVMKVEKAPLESYADIGGLDSQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 14933 - protein, 326 aa, Pyrococcus furiosus DSM 3638
MKILLIGMGGTIASVKGENGYEASLSVKEVLDIAGIKDCEDCDFLDLKNVDSTLIQPEDWVDLAETLYKNVKKYDGIIVTHGTDTLAYTSSMISFMLRNPPIPIVFTGSMIPATEENSDAPLNLQTAIKFATSGIRGVYVAFNGKVMLGVRTSKVRTMSRDAFESINYPIIAELRGEDLVVNFIPKFNNGEVTLDLRHDPKVLVIKLIPGLSGDIFRAAVELGYRGIVIEGYGAGGIPYRGSDLLQTIEELSKEIPIVMTTQAMYDGVDLTRYKVGRLALRAGVIPAGDMTKEATVTKLMWILGHTNNVEEIKVLMRKNLVGELRD

SEQ ID NO: 14934 - protein, 295 aa, Oceanobacillus iheyensis HTE831
MRTIKKAIIPAAGLGTRFLPATKAMPKEMLPIVDKPTIQYIVEEAIESGIEDIIIVTGKGKRAIEDHFDHNFELEDNLVKKEKFDLLDKVNHASSVDLHYIRQKEPKGLGHAVWCARKFIGNEPFAVLLGDDIVRADTPGLRQLIEQYEETQSSVVGVQQVPDTETHRYGIVDPSMIEGRRYKVNHFVEKPAQGTAPSNLAIMGRYVFNPEIFQFLDKQQIGAGGEIQLTDAIQMLNEIQPVYAYDFLGKRYDVGEKLGFVKTTIDLALENAEIKDELFSYLEEKVTEKAIKTNY

SEQ ID NO: 14935 - protein, 370 aa, Glycine max
  unsure (1)..(370): unsure at all Xaa locations
EALEKWSQPVMWKLLPRHMEIIQEIDKRFTAMINTTRLDLESELSSMRILDDNPQKPVVQMANLCVVSSHAVNGVAQLHSDILKSELFANYVSIWPTKFQNKTNGITPRRWLQFCNPELGGIXTKWLKTDKWVTNLDLLTGLRQFADNEDLQAEWLSAKMASKQRLARYVLQVTGESIDPDTLFDIQVKRIHEYKRQLLNILGVIYRYKKLKEMSLEERKNTTPRTVMIGGKAFATYTNAIRIVRLVNDVGAVVNSDPEVNGYLKVVFVPNYNVSVAEVLIPGSELSQHISTAGMEASGTSNMKFALNGCLIIGTLDGANVEXXXXXGEDNFFLFXAXAEDVPXLXKEXXNGLXKPXPRFEEAKKFIXEW

SEQ ID NO: 14936 - protein, 358 aa, Staphylococcus epidermidis ATCC 12228
MSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLIDVERDWVPEGEGQSLYIRPFVFATEGVLGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 14937 - protein, 312 aa, Vibrio parahaemolyticus RIMD 2210633
MATKTADFIWFNGEMVPWAEANVHVLTHAMHYGTSVFEGVRCYNTPKGPIVFRHREHAQRLKDSAKIYRFPIPYSVEEIMEATRETLRQNKLDSAYIRPLGFVGNVGLGVCPPVGAEMELIIAAFPWGSYLGEEALEKGVDAMISSWNRAAPNTIPTAAKAGGNYLSSLLVGGEARRHGYDEGIALSVDGYLSEGAGENIFVIKDRVITTPPATSAILPGITRDSIMTIARDKGYEVREANIAREALYLADEVFMTGTAAEVVPVATIDKIEVGSGKRGPITKELQEAYFGLFNGTTEDKWGWLDYVYPEQQ

SEQ ID NO: 14938 - protein, 287 aa, Vibrio cholerae
MKGIILAGGSGTRLHPITKGVSKQLLPIYDKPMIYYPLSVLMLAGINEILIITTPEEQDGFIRLLGDGSQFGIRLSYAVQPSPDGLAQAFIIGEEFIGKDDICLALGDNIFFGQAFGKQLKHAVQNLTGATVFGYQVMDPERFGVVEFDADFKALSIEEKPADPKSNWAVTGLYFYNNSVIDIAKKVKPSERGELEITSVNQAYLEQGSLKVEQLGRGFAWLDTGTHDSLLEASQFVQTVEKRQGFKIACLEEIALLQGWLTKQQVRETAMTLSKTGYGQYLLNITK

SEQ ID NO: 14939 - protein, 272 aa, Oryza sativa (indica cultivar-group)
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPVVVEPCFSAGDDWMDDVRALASFLDTDDAWNLCA

SEQ ID NO: 14940 - protein, 93 aa, Zea mays
  unsure (1)..(93): unsure at all Xaa locations
IEKFKIFISYILWVNLKAIDRLEEAEALKMEIIPNPKEVDGVKVLXTXTASGASIRFFDKAIGINVFCSRFFPLNATFDXLLRWQSDLYTIDY

SEQ ID NO: 14941 - protein, 370 aa, Staphylococcus epidermidis ATCC 12228
MAPKLQAQFDAVKVLNETQSKFEMVQILDEDGNVVNEDLVPDLTDEQLVELMERMVWTRILDQRSISLNRQGRLGFYAPTAGQEASQLASQYALESEDFILPGYRDVPQIIWHGLPLTDAFLFSRGHFKGNQFPEGVNALSPQIIIGAQYIQTAGVAFGLKKRGKNAVAITYTGDGGSSQGDFYEGINFASAYKAPAIFVIQNNNYAISTPRSKQTAAETLAQKAISVGIPGIQVDGMDALAVYQATLEARERAVAGEGPTVIETLTYRYGPHTMAGDDPTRYRTSDEDAEWEKKDPLVRFRKYLEAKGLWNEDKENEVVERAKSEIKAAIKEADNTEKQTVTSLMDIMYEEMPQNLAEQYEIYKEKESK

SEQ ID NO: 14942 - protein, 180 aa, Zea mays; identical to SEQ ID NO: 11969

SEQ ID NO: 14943 - protein, 480 aa, Paraglossum sp.
ARIKNERYESGVIPYAKMGYWDPEYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAASGEVKGHYMNITAATMENMYERAEFAKDLGSVIIMIDLVIGYSAIQSMAIWARKNDMILHLHRAGNSTYSRQKIHGMNFRVICKWMRMAGVDHIHAGTVVGKLEGDPLMIQGFYNTLLLPYLDVNLPQGIFFEQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTPDFVETPTANV

SEQ ID NO: 14944 - protein, 259 aa, Corynebacterium glutamicum ATCC 13032
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 14945 - protein, 227 aa, Eremothecium gossypii
MDTTQLNQSKLGTREYWDEFYAVEQRNFEADAQDTGECWFDEDRAAERMVEFLEEHVGEWRIAPDAAVLDVGCGNGHLLFALADAGFNGRLRGRDYSERSVQLARAIGATHDADVGFHAADVFSAAWQPGVFDVVLDKGTLDAIALSGMQPAGAASVPAAYAAVVERVLAPGGVLLITSCNFTEDELVRLVEAGSGLRKCGRIAYPEFGFGGKKGSTICSVAFTKAM

SEQ ID NO: 14946 - protein, 162 aa, Zea mays subsp. parviglumis
RRRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVG

SEQ ID NO: 14947 - protein, 638 aa, Helicobacter felis
MDNNHKGPNDPNSKKPLLQNPLLLIAIFGIIIFVAMRVMNSDEGFGDRFLSTSTKNISYHEMKELIEKKEVDSVSIGQTLIKAISKEGNNKTIYVAKRVPDLSLVPLLDSQKINYSGFSESNFFADILGWLLPVLVILGLWMFMASRMQKNMGGGIFGMGSSKKLINAEKPKVRFNDMAGNEEAKEEVVEIVDFLKYPDRYASLGAKIPKGVLLVGPPGTGKTLLAKAVAGEASVPFFSMGGSSFIEMFVGLGASRVRDLFDIAKKEAPSIIFIDEIDAIGKSRAAGGMISGNDEREQTLNQLLAEMDGFGSENAPVIVLAATNRPEILDPALLRPGRFDRQVLVDKPDFKGRVEILKVHIKPVKLANDVDLQEIAKLTAGLAGADLANIINEAALLAGRNNQKEVKQQHLKEAVERGIAGLEKKSRRISPKEKKIVAYHESGHAVISEMTKGSARVNKVSIIPRGMAALGYTLNTPEENKYLMQKHELIAEIDVLLGGRAAEDVFLQEISTGASNDLERATDIIKGMVSYYGMSDVSGLMVLEKQRNSFLGGGFGSGREFSEKMAEEMDSFIKNLLEERYVHVKQTLSDYKDAIEVMVNELFEKEVITGERVREIISEYEVSHNLQTRLVPLEEHAS

SEQ ID NO: 14948 - protein, 246 aa, Oryza sativa (japonica cultivar-group)
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 14949 - protein, 90 aa, Zea mays
MDEEEHEVYGQEIPEDGDMDGADVDMDACGDDATKLQELDEMKRKLKEMDEEAAALRDMHAKVAKEMHGCDPSASTTEANEQVDARSLYV

SEQ ID NO: 14950 - protein, 570 aa, Bacillus anthracis str. A2012
MKQYTTYEKLQCEEVTGAGHVIQCLKKLGVTTVFGYPGGAILPVYDALYESGLKHILTRHEQAAIHAAEGYARASGKVGVVFATSGPGATNLVTGLADAYMDSIPLVVITGQVATPLIGKDGFQEADVVGITVPVTKHNYQVRDVNQLSRIVQEAFYIAESGRPGPVLIDIPKDVQIEKVTSFYNEVIEIPGYKLEPRPDSMKLREVAKAISEAKRPLLYIGGGIIHADGSEELIQFARKKGIPVVSTLMGLGAYPPGDPLFLGMLGMHGTYAANMAVTECDLLLALGVRFDDRVTGKLELFSPHSKKVHIDIDPSEFQKNVAVEYPVVGDVKKALHMLLHMSIHTQTDEWLQKVKTWKEEYQLSYKQKESELKPQHVINLVSELTNGEAIVTTEVGQHQMWAAHFYKAKNPRTFLTSGGLGTMGFGFPAAIGAQLAKEEELVICIAGDASFQMNIQELQTIAENNIPVKVFIINNKFLGMVRQWQEMFYENRLSESKIGSPDFVKVAEAYGVKGLRATNATEAKQVMLEAFAHKGPVVVDFCVEEGENVFPMVPPNKGNNEMIMKRWEE

SEQ ID NO: 14951 - protein, 500 aa, Ralstonia metallidurans
MGGDHRSDRWTDGGTGRSRRAGARRTRRNQHSRCILPARGQNRVPLYSVDPTPSAVDSGTPDTMTPATPPIAVVGGQPVPDGHAGATSRNGAKVPFEAGIRLAGVGKFQYRLFVIFGLVWLADAMQVLSIGFSAPSIAKTFGITMPQALQTGTLFFVGMLVGAIVFGRLADRIGRRPVLMIAIVIDALSGIASAFAPELSWLLVLRFLTGVGVGGTLPVDYTMMAEFLPSDRRGRWLVLLESFWAIGTICLAVLALVALSHGDQAWRVIFLVTGIPALIGVVLRFYIPESPMYLNRSGRSDEARKVLQRVAKTNGRNVEIPALQSDIVAPKSVLTLFSGTFRRRSFALFAAWALISIAYYGVFVYLPIKLGAEGFAFMRGQVFLVVLAIVQLPGFALSAYGVERWGRKPTLIGFLLLSAVGCMLYSLGTSPTVVVGSTLLMSFALLGTWGALYAFTPEVYPTDLRATGMGAAGAVARFGGLFAPAIIAPVMATHFTWPSR

SEQ ID NO: 14952 - protein, 159 aa, Glycine max
MDFRVMGLEPPLFHTLQHMMDMSEDAAGENKTYSAPTRSYVRDAKAMAATPADVKEYPNSYVFEIDMPGLKSGDIKVQVEDDNVLLISGERKRDEEKEGVKYLRMERRVGKFMRKFVLPENANTDAISAVCQDGVLSVTVQKLPPPEPKKPRTIEVKVF

SEQ ID NO: 14953 - protein, 318 aa, Pyrococcus furiosus DSM 3638
MINQINFKTSHGGSREEGYIDFSASVNPYPPEWTDEMFERAKKISTFYPYYEKLEEELSDLIGEPITITAGITEALYLLGVWMRGRKVIIPKHTYGEYERISRMFGGRVIKGPNDPGKLAEFVERNSFVFFCNPNNPDGKFYREKEMKPLLDAIQDTNSILILDEAFIDFVKKPESPEGENIIRLRTFTKSYGLPGVRVGYVIGFVDAFRSVRMPWSIGSTGVAFLEFLLKDNFKHLRKTLPLIWKEKERIEKELKVKSDANFFIMKVREGIIEKLKENGILVRDCKSFGLPGYIRFSVRRREENDKLINILRKTLNT

SEQ ID NO: 14954 - protein, 267 aa, Hordeum vulgare
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 14955 - protein, 314 aa, Triticum aestivum
MALASTTASRLISRRLAAPLPPPPSSSCAAPRGGARPGPRRFAVRWEGRPRALLGGFSDAGEDASDDEDEEDGPGALSGGPPRQEKGCEDVIELAAAAFSGPERWDVLGLGQAMVDFSGMVDDEFLERLGIEKGTRKVVNHEERGRVLRAMDGCTYKAAAGGSLSNSLVALAWLGSSRASHCYSKLRVAMAGSVGSDPLGSFYRQKLHRANVQFLSKPVKDGTTGTVIVLTTPDAQRTMLAYQGTSSTLAYDSDLAEIVSKSNLLIVEGYLFEFSHTIEAIKQACEDAKKNGALIAVSASDVSCIKRCHSDFWD

SEQ ID NO: 14956 - protein, 310 aa, Oryza sativa (japonica cultivar-group)
MAEKKKKKKKKKPQSLLVLTSWRSIGMGRGRVELKRIENKINRQVTFAKRRNGLLKKAYELSVLCDAEVALIIFSNRGKLYEFCSTQSMTKTLEKYQKCSYAGPETAVQNRESEQLKASRNEYLKLKARVENLQRTQRQYYKSKHRLCLVRSKVWNLVKIRDDVTEKLCMYERNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 14957 - protein, 179 aa, Pseudomonas syringae pv. syringae B728a
MKAKADTPFVALNIAVLTVSDTRTRETDTSGQMFVDRLTDAGHGLIERVLLKDDLYKIRAQVATWIADDQVQVVLITGGTGFTGRDSTPEAVACLLDKQVDGFGELFRQISVPDIGTSTIQSRALAGLSNGTLVCCLPGSTNAVRTAWDGILAQQLDSRFRPCNFVPHLKQAEPCATRG

SEQ ID NO: 14958 - protein, 458 aa, Bacillus subtilis subsp. subtilis str. 168
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 14959 - protein, 141 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 14960 - protein, 243 aa, Zea mays
  unsure (1)..(243): unsure at all Xaa locations
TYLDGCDYPSWHAIHIFDSRGNPTVEIDMFGSNVTIVRLAVLTGAYPGVYDALELRDDGSDYLYKAVTKGVXNVNXVIGPALIAKVPYRSDCMIDNFMXHHVDGTIYECLWSKHNLAANAILYVTLAVCIAGNSINSIPLYHHIDNLCDNNNLMMPAAAFHVIDGXGSHAXNKLAMQEFMIXLPTGAGSLNEAMNMNGEHYHHLKYRIINEYAKEATNDEAKCALAPNIPHNEEGLELLKTAL

SEQ ID NO: 14961 - protein, 591 aa, Thermoanaerobacter tengcongensis
MGCSVSRRNSMRKVIIVFLVLITLLFLFLYLHPADKRNHSEKDPIDELIKNMTVEEKIGQMLMPAIDGTKATPQLEKMIKDYHLGGVILFSENIQSIEQIVKLTNDIQSLSLQIPLFISTDQEGGLVYRLSQGTKFPGNMALGATFSEDLAYKVGKVIGSELKAVGINWDLAPVMDVNVNPYNPVIGIRSFGGNPDVVAKLGVAFMKGLQENKIASCVKHFPGHGDVDVDSHLGLGTVNKNRETLEKIELKPFEEAIQAGTDALMTAHLSFPALDDTKVIAKTSEGVQKEITIPATLSHKILTDLVRKTWGYEGVIITDAMNMKAISDNFGPVDAVVRAVKAGADIILMPVDLNGAFNELVLETKKGIISEKRIDDSVRRILKLKYKLGLMETKDIDLENMIQQARAIVGNEKNLLVEKEVAERSITLLRNSGNLLPLGKETLNKKILIIGGTKDLVNGFVNELKKYHPGNNAFLVINNGTLRGSGSLTSDLKKAIDGSDIVILMTNNIMSPNSLAEKIVNYGGDKVIGIAVRNPYDIMYYPQVKVYLVQYGWNPCSIKAMVDVLFGAVNPTGKLPVEIPGLYPIGYGLSY

SEQ ID NO: 14962 - protein, 246 aa, Tsuga mertensiana
YTYNLRNKGPEDVIVRVIYCGICHSDLIQVRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNGK

SEQ ID NO: 14963 - protein, 427 aa, Batrachospermum macrosporum
IEASAAVAGESSTATWTVVWTDLLTACDLYRAKAYKVDAVPNTADQYFAYIAYDLDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWRERFLFSIEGVNRAQAATGEVKGHYLNVTAGTMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYDTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADFV

SEQ ID NO: 14964 - protein, 402 aa, Daucus carota
MVATTLESPRVETLAGSGIQLIPKEYVRPKDELISITNIFEEEKSDEGPQVPTVDIADILSEDKAVREKCYERIKDAAVEWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNTVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPEEQQKTEESNPQKIEILKPGEEASSSP

SEQ ID NO: 14965 - protein, 237 aa, ASPERGILLUS NIDULANS FGSC A4
MANDEYDVSPRPLTFLFKVVLIGDSGTGKSNLLSRFTRNEFNLDSKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTGIAPVGISKRRSLTAILFFVEIYRIVSSKALEGESGGASVGERRQIIDIEKTQDTENKGGCC

SEQ ID NO: 14966 - protein, 487 aa, Streptomyces coelicolor A3(2)
MSQRVLTTESGAPVADNQNSASAGIGGPLLIQDQHLIEKLARFNRERIPERVVHARGSGAYGHFEVTDDVSGFTHADFLNTVGKRTEVFLRFSTVADSLGGADAVRDPRGFALKFYTEEGNYDLVGNNTPVFFIKDPIKFPDFIHSQKRDPFTGRQEPDNVFDFWAHSPEATHQITWLMGDRGIPASYRHMDGFGSHTYQWTNARGESFFVKYHFKTDQGIRCLTADEAAKLAGEDPTSHQTDLVQAIERGVYPSWTLHVQLMPVAEAANYRFNPFDVTKVWPHADYPLKRVGRLVLDRNPDNVFAEVEQAAFSPNNFVPGIGPSPDKMLQGRLFAYADAHRYRLGVNHTQLAVNAPKAVPGGAANYGRDGLMAANPQGRYAKNYEPNSYDGPAETGTPLAAPLAVSGHTGTHEAPLHTKDDHFVQAGALYRLMSEDEKQRLVANLAGGLSQVSRNDVVEKNLAHFHAADPEYGKRVEEAVRALRED

SEQ ID NO: 14967 - protein, 309 aa, Agrobacterium tumefaciens str. C58 (U. Washington)
MAIQKQMDAREWAMLIALSLLWGGSFFFIGVAVKELPPVTIVTLRVSLAAVALLVVCRIMGLRLPREWAVWRAFFGMGLLNNIIPFCLIVWGQTQIASGLASILNATTPLFTVIVAHFLTADEKMTGNKLAGVLIGFVGVATMIGPAAFGGSSGLWGQIAILGAAISYSFAGIFGRRFKAMGVPPLMTATGQISSSTLMLIPAALLIDKPWTLAMPGLGTWGALIGIALLSTALAYLIFFRILASAGATNLALVTFLIPVSAILLGSLILGEQLEIKHFAGMAMIAAGLAAIDGRLPVKLRSLLRNAPA

SEQ ID NO: 14968 - protein, 365 aa, Candida boidinii
MSIIEKKIVLLPGDHVGVEVVEEAVKILKSISEVKPEIQFKFENHLIGGAAIDATGVPLPDEALEAAKKSDAVLLGAVGGPKWGTGEVRPEQGLLKIRKELNLYANLRPCNFASDKLLDLSPLKSDIVKGTDFTVVRELVGGIYFGDRVEDDGSGFASDSESYSVPEVERITRMAAFLSLQNDPPLPIWSLDKANVLASSRLWRKTVDRVIKEEFPKLTVQHQLIDSAAMILVKSPTKLNGIVITNNMFGDIISDEASVIPGSLGLLPSASLASLPDTNQAFGLYEPCHGSAPDLPKNKVNPIATILSAAMMLKLSLNLVKEGNAVEEAVRKVLDQGIMTGDLGGNNSTTEVGDAIAKEVKLLLA

SEQ ID NO: 14969 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATPGTAPKYAGQDKVNPGSIILSAEMMLRHMGWTEAADLIVKGMEGAINAKTVTYDFERLMEGAKLL

SEQ ID NO: 14970 - protein, 107 aa, Zea mays
TRPAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 14971 - protein, 440 aa, Cladosporium herbarum
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 14972 - protein, 337 aa, Oryza sativa
MSSSSNSDSGKKGGNPLEAMGAFFSSQVNRRKLVTSEKQALATRLSAGGEAFPGSEHRPADRKTWMAELGPERLRVHQLVWPGTHDSATNKIGIPFVTRPFAQCQSLSVYEQLAAGARVIDVRVQEERRVCHGVLATYSVDVVLDDVRRFLGETASEVVILEVRTEFGHDDPPEFGRYLVEQLGEHLIPQDEAVFHKTIAELLPRRLICVWKPRKSPAPKPGEPLWSAGYLRDNWIDTDLPETKFESNVKFLGEQPPVADRRFFYRVENTVTPQADNPVLCVRPVTRRIHGYARLFIAEVFAKGLGDKLQVFSTDFIDGDFVDACAGVTKARVDGAA

SEQ ID NO: 14973 - protein, 356 aa, Shigella flexneri 2a str. 301
MSTVTITDLARENVRNLTPYQSARRLGGNGDVWLNANEYPTAVEFKLTQQTLNRYPECQPKAVIENYAQYAGVKPEQVLVSRGADEGIELLIRAFCEPGKDAILYCPPTYGMYSVSAETIGVECRTVPTLENWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIPPYPLSTPVADIAAQALSPQGIVAMSERVAQIITEREYLIAALKEIPCVEQVFDSETNYILARFKASSAVFKSLWDQGIILRDQNKQPSLSGCLRITVGTREESQRVIDALRAEQV

SEQ ID NO: 14974 - protein, 282 aa, Glycine max
MDSLCCFSSVSQVVGGRSSCNSGKGKSSQSSVKYGYSLVKGKANHPMEDYHVAKFVQFKGRELGLFAIYDGHLGDSVPAYLQKHLFSNILKDEDFWNDPFMSISNAYETTDQAILSHSPDLGRGGSTAVTAILINNQKLWVANVGDSRAVVSRGGVAGQMSTDHEPNTERGSIETRGGFVSNMPGDVARVNGQLAVSRAFGDKNLKTHLRSDPDIQYTDITPDVELLILASDGLWKVMANQEAVDVARRIKDPQKAAKQLATEALNRDSKDDISCIVVRFKG

SEQ ID NO: 14975 - protein, 542 aa, Escherichia coli CFT073
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEIDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTIEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 14976 - protein, 327 aa, Pseudomonas stutzeri
  unsure (1)..(327): unsure at all Xaa locations
CIGCHTCSITCKNVWTSREGMEYAWFNNVETKPGIGYPKEWENQDKWKGGWVRNGDGTINPRIGGKFRVLANIFANPDLPTIDDYYEPFDFDYQNLHTAPISDHQPVARPRSLISGQRMEKIEWGPNWXEILGTEFAKRRKDKNFDKIQADIYGQYENTFMMYLPRLCEHCLNPTCAASCPSGAIYKREEDGIVLFDQEKCRGWRMCISGCPYQQIYFNWKSGKSEKCIFCFPRIEAGIPTVCAETCVGRIRYLGVLLYDADRIHEVASTVNEQDLYAKQLEIFLDPFDPKVIEQALNDGVPMSVIEAAQKSPVYKMAVDWNAWPCR

SEQ ID NO: 14977 - protein, 769 aa, Streptomyces antibioticus
MTLEEKLSFVHWSYHTSDESAKVYLPGVPRLGIPEMRATDGPAGITIHRPSLALPAPVALASTFDDGLARSYGAVIGREGRAFGQDVVFAPMVNSIRVPYAGRNFETFSEDPLVTSRMAAAEIKGIQSQGLIAATKHYAANNQEKNRFSVNVNVDEQTLRERELPGFESAVAAGTGSVMCAYNKVNGQPACGSDELLNKVLKEQWKFRGWVTSDWLATQSTDALTKGLDQELGIELDHEPAPGEPIPGGKFFGDPLKTAIREGRIPESALDEAVTRIVSQMARFRLLDEDPPARPARDLAGGLKVARQVAEDGAVLLRNEGATLPLTTETAADIAVIGPTAKVPKVTGLGSSYIVPDGASAPLDTIRERAGAGSTVRYSTGEETVGVPVPQSAPLPRPRPSGEVFPAGGGGVLYDGTITVPVTGSYRIAARAQGGNAYVELDGQEPFGRRPWVYGDVSSRPMRLAAGTHKLRITGAALAKSPMTFELTWVTPQAAQEAIDRAVSIARTARTAVVFAYDDGSEDGDRTSLSLPGRQDDLISAVAAVNPRTVVVLNTGSSLTMPWLRKTAAVLTMWYPGQAGAEATTALLFGDADPGGRLTQTFPADEGQTPFAGDARRYPGVDDQLDYSEGIYSGYRWYEQQGVQPLFSFGHGLCYTSFDYRDLKVTATADGGLDVCFTLRNTGTRTGKEVPQVYVGPSPHVRVAQAKRALAAYGKVELRPGESRRLTLHVERRALQNWDSGAHTWVTGPGRQVMVGPSLGRLPLSATAP

SEQ ID NO: 14978 - protein, 64 aa, Glycine max
  unsure (1)..(64): unsure at all Xaa locations
MVLDETIICDDKSEWIRNGDYSPSRFQTQAXAVNLNCGAKTQSNPEDTVRVLTKAENGVRVMVI

SEQ ID NO: 14979 - protein, 495 aa, Oryza sativa
PTRPVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 14980 - protein, 228 aa, Zea mays
MLFLHCQSCIPSRPRPRRPTPPFRPRVSVAAPLSVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 14981 - protein, 470 aa, Pterocladiella capillacea
GVIPYAKMGYWDPDYAVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIIMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 14982 - protein, 1398 aa, Arabidopsis thaliana
MTKALNLGFPTNSYAFVFLVASSKSLTSKTLKIFQRVSASERESYLFSREVRVLEIDNWIYGWIWCKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRKKEAGSSKLGLEENMDRTRPSDNKSDRDSLSPDTGPPRSLSPTLPPSGSRLQNVASSSGTGMSLDTNNILKWLMGILNGNYERNTYWQLAVLVLVINLFRVLLVMSMLACRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSELVGKLLSLVFVGYAISLNWINVATQAEECEGHAEFESGIPVDYSFSNFSFKNLSQLASINYDLLSKGWKDEPQQIPHHK

SEQ ID NO: 14983 - protein, 245 aa, Malus x domestica
GKVELKRIENKSNRQVTFSKRRNGLLKKAFELSVLCDAEVALIIFSGRGKLYEFSSSLSMMKTLERYQRCSYSSLDANRPANETQNSYQEYLQLETRVEALQQSQRNLLGEDLATLNTKKLEELEHQLETSLNKIRSTKTQFMLDQLSDLQNREQMLVEANKALRRKLEETSVQAPQFMAWEAAGDGHNNIQQTWLPSNSEAFFHPFGGNNSTSQIGYAHLGSHNGMDVGNPGQHVNGYIPGWML

SEQ ID NO: 14984 - protein, 255 aa, Petunia integrifolia
MSTSNASTSGVRKGAWTEEEDLLLRECIEKYGEGKWHLVPVRAGLNRCRKSCRLRWLNYLRPHIKRGDFSLDEVDLILRLHKLLGNRWSLVAGRLPGRTANDVKNYWNTHLRKKLIAPHDQKQESKNKAMKITENNIIKPRPQTFSRPAMNHVSCWNGKSCSKNTIDKNEGDTEIIKFSDEKQKPEESIDDGLQWWANLLANNIEIEELVSCNSPTLLHEETAPSVNAESSLTQGGGSGLSDFSVDIDDIWDLVS

SEQ ID NO: 14985 - protein, 300 aa, Vibrio parahaemolyticus RIMD 2210633
MGYTHAGHIDALNQNIAELSDNINVSFEFFPPSSEKMEETLWNSVHRLKTLKPKFVSVTYGANSGERDRTHSIIKEIKAETGLVAAPHLTCIDATRSELIEIADDYWNNGIENIVALRGDIPPGGGAPDMYASDLVELLKSRHDFDISVAAFPEVHPEAKSAQSDLLNLKRKVDAGANRAITQFFFDVESYLRFRDRCVAAGIDVEIVPGILPVSNFKQASRFAAQNNVKVPGWMSKQFEGLDDDPVTRQLVGASQAIDMVRVLSREGVKDFHFYTLNRAEMTYALCHTLGVRPRVAVEA

SEQ ID NO: 14986 - protein, 216 aa, Glycine max
WNRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 14987 - protein, 352 aa, Neurospora crassa
MSSAQRGGARKISFNVSEQYDIQDVVGEGAYGVVCSAVHKPSGQKVAIKKITPFDHSMFCLRTLREMKLLRYFNHENIISILDIQKPRSYETFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSELALDLLEKLLAFNPVKRITVEEALKHPYLEPYHDPDDEPTAPPIPEEFFDFDKHKDNLSKEQLKQLIYQEIMR

SEQ ID NO: 14988 - protein, 163 aa, Oryza rufipogon
MEELEGHRGAGRLPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 14989 - protein, 248 aa, Chlamydomonas reinhardtii
MASAFERPRHAAGLDFDVEKGAALNAFAERTVRQGFVRKVFGLLAVQLALTTVIAGTFVTSTAVKTFVAAHPWVLMLGMLAGFGILLTLTLSSSARQSHPTNLILLFVFTAAEGVLVGAASSASRTDVVLLAFGLTAGITAAMTVYALTTKNDLTMSGAALYSCLWGLLLAGLVGMFVRTSAFNILLSAVGAVVFSVYIAYDVQCLLGGEHKYAVSPDEYVLGAIAIYLDIINLFMHILRLLNEANRN

SEQ ID NO: 14990 - protein, 464 aa, Bacillus cereus ATCC 14579
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 14991 - protein, 364 aa, Nicotiana tabacum
MAFQIARRLLRSRASSSIRYLDRSFSSESNSNLIRATLFPGDGIGPEIADSVRQIFKTAEVPIEWEEHYVGKEIDPRTNSFLTWESLESVRRNKVGLKGPMATPIGKGHRSLNLTLRKELNLYANVRPCYSLPGYKTRYDDVNLITIRENTEGEYSGVEHQVVRGVVESLKIITRQASLRVAEYAFHYAKAHGRERVSAIHKANIMQKTDGLFLKCCREVAEKYPEIKYEEVVIDNCCMMLVKNPALFDILVMPNLYGDIISDLCAGVIGGLGLTPSCNIGEGGIALAEAVHGSAPDIAGKNLANPTALLLSAVTMLRHLELHDKADRIQGAVLNTIAEGKYRTGDLGGTSSTTDFTNAICDHL

SEQ ID NO: 14992 - protein, 463 aa, Streptococcus pyogenes SSI-1
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 14993 - protein, 122 aa, Zea mays
MMSAKRLVQMSSSRWRRMAALARKRLASTPVKETDGSSCSTSSVAGKGHCAMYSADGRRFEVPLVFLGTALFGELLSMSQEEFGFAGDDGRITLPCESLVMEYMMCLLTRDASEEVKRLFLS

SEQ ID NO: 14994 - protein, 553 aa, Zea mays
FFFLLSVRQDGNCIVLNWEIATALAVVRSVTDAIYFLHMLLQFRLAYVAPESRVVGAGDLVDEPKKVAIHYLRVPFLLDFVVVLPLPQVMILLVVPKVGLSAANYAKNLLRVTVLLQYVPRIIRFVPLLDGQSTNGFIFESAWANFVINLLMFILAGHVVGSCWYLFGLQRVNQCLRDACSISTIPYCDSFIDCGRGIGSGLYRQQWFNDSGAEACFNTGNDATFQYGIYEQAVLLTTEHSAVKRYIYSLFWGFQQISTLAGNLVPSYFIWEVLFTMAIIGLGLLLFALLIGNMQNFLQALGRRRLEMQLRRRDVEKWMSHRRLPEDLRRRVRRAERFTWAATQGVNEEELLSNLPEDIQRDIRRHFFRFLNKVRLFTLMDWPILDAICDKLRQNLYISGSDILYQGGTVEKMVFIVRGKLESISADGSKAPLHDGDVCGEELLTWYLEHSSANRDGGKIKFQGMRLVAIRTVRCLTNVEAFVLRASDLEEVTSQFARFLRNPRVQGAIRYESPYWRTIAATRIQVAWRYRKRRLKRAEKSRLSEETYASLGS

SEQ ID NO: 14995 - protein, 307 aa, Vibrio alginolyticus
MNQVWVTGDAVVDLIPESETSLLKCPGGAPANVAVAIARLSGKSAFFGRVGDDPFGRFMQSILDQEGVCTEFLIKDPEQRTSTVVVDLDDQGERSFTFMVKPSADQFMSVEDMGNFKQGDWLHVCSISLANEPSRSSTFEAIKRAKAAGGFISFDPNLRDEVWQDQSEIQAVVMKAVAMADVVKFSEEELLFLTDSTSMAQGLQQIAAMNIALVLVTQGAKGVWRVFESQSELITGQVVSPIDTTGAGDAFVGGLLACLSRHADWKNHPVVSSAIQWANGCGALATTQKGAMTALPTQTELLRFIGQ

SEQ ID NO: 14996 - protein, 324 aa, Bacillus subtilis subsp. subtilis str. 168
MKLDAVTFGESMAMFYANEYGGLHEVSTFSKGLAGAESNVACGLARLGFRMGWMSKVGNDQLGTFILQELKKEGVDVSRVIRSQDENPTGLLLKSKVKEGDPQVTYYRKNSAASTLTTAEYPRDYFQCAGHLHVTGIPPALSAEMKDFTYHVMNDMRNAGKTISFDPNVRPSLWPDQATMVHTINDLAGLADWFFPGIAEGELLTGEKTPEGIADYYLKKGASFVAIKLGKEGAYFKTGTSEGFLEGCRVDRVVDTVGAGDGFAVGVISGILDGLSYKDAVQRGNAIGALQVQAPGDMDGLPTREKLASFLSAQRTVHQKKGDY

SEQ ID NO: 14997 - protein, 462 aa, Lactobacillus gasseri
MQQFGVIGLSVMGKNLALNVKNHGYSVSGFSIDKPEVDALAKYEDKDLKPTYTWEEFVNSLEKPRKILVQIMAGKPVDETLQKLLPLLDKGDIVIDGGNSNFYDTNRRYEEMEKHGIHFIGMGVSGGEEGALNGPALMPGGDEKAYEEVSPILEAMAAKTPTGQPCVGYIGPAGSGHYVKMVHNGIEYGIMQIISEVYDVLRTVGHYSNDEMSEIFKNWDKGALQAYLIEITAKVLKQKDNLTDDHIIDHILNEASYKGTGNWMLEDAIRLGAPITVIAEAVLARFMSKATLRDDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENISALREVVKIAADAGVPTPTLSAALNYLESIFNPRLPQNIIQGQRDYFGAHTYQRNDRPGTFHTEWYEEK

SEQ ID NO: 14998 - protein, 318 aa, Pythium graminicola
SKVGINGFGRIGRLVLRAAQTNPLINVVAINDPFIPTKYMEYMLRYDTVHGVFNGTVSHDEENLIVNGKKVRVFNEMKPTDIKWSQADVQYVVESTGVFTTTEKASAHLQNGVEKVVISAPSADAPMFVVGVNEDKYKSDMHVVSNASCTTNCLAPLAKVVNDTFGIKEGLMTTVHAVTATQLTVDGPSKKDWRGGRGACFNIIPSSTGAAKAVGKVIPSLNGKLTGMSFRVPTADVSVVDLTCRLEKKASYDEIKQVIKAASENELKGILGYTDELVVSSDFVGDSRPSIFDAQAGIALTDDFVKLVSWYDNEWGYS

SEQ ID NO: 14999 - protein, 769 aa, Bacteroides thetaiotaomicron VPI-5482
MNVVAFAQSSLLPYKNPVLSVDERVKDLLSRMTLEDKVGQLLCPLGWEMYEIKDDEVHPSEKFKRLMKEKNAGMLWATYRADPWTKKTLENGLNPELAAKAGNALQKYVIENTRLGIPLFLAEEAPHGHMAIGTTVFPTGIGMAATWSPTLIEEVGNVIAKEIRSQGAHISYGPVLDLSRDPRWSRVEETFGEDPVLSGRLGAAMILGLGSGDLSCEYATIATLKHFLAYAVPEGGQNGNYASVGTRDLHENFLPPFREAIDAGALSVMTSYNSIDGVPCTANHYLLTQLLRNEWRFRGFVVSDLYSIEGVHESHFVAPTIEEAAMQAVSAGADIDLGGDAFMNLTHAVQFGKISEAVIDTAVCRVLRMKFEIGLFEHPYVNPKTATKIVRSKDHIKLARKVAQSSIVLLKNENSILPLNKKIKKVAVVGPNADNRYNMLGDYTAPQEDENIKTVLDGVISKLSPSKVEYVRGCAIRDTTVNEIAEAVEAASRSEVIIAVVGGSSARDFKTSYQETGAAIADEKSISDMECGEGFDRATLTLLGKQQDLLIALKATGKPLIVVYIEGRPLDKVWASEYADALLTASYPGQEGGYAIADVLFGDYNPAGRLPVSIPRSVGQIPVYYNKKAPRNHDYVEQAASPLYTFGYGLSYTTFEYSDLQVIRKSPCHFEVSFKVKNTGSYDGEEVAQLYLRDEYASVVQPLRQLKCFERFFLKRGEEKEIFFTLTEKDLSIIDRNMKRVVETGDFRIMIGASSDDIRLTKDISVESL

SEQ ID NO: 15000 - protein, 400 aa, Zea mays
MEAPPGPGPMELDAPPPAAAAAAIPPAGSDKHKDGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLIPGEPNISYICSRYYRAPELIFGATEYTSSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRTPNARLPNGRPFPPLFNFKHELANASPDLVSRLVPEHIRRQIGVNFGSS

SEQ ID NO: 15001 - protein, 317 aa, Candida albicans
MVELSDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGANMIKRFMNQLIRGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPNEEIWPDVNYLPDFKSSFPQWKKKPLSEAVPSLDANGIDLLDQMLVYDPSRRISAKRALIHPYFNDNDDRDHNNYNEDNIGIDKHQNMQ

SEQ ID NO: 15002 - protein, 299 aa, Mycobacterium tuberculosis H37Rv
MDPAGNPATGTARVKRGMAEMLKGGVIMDVVTPEQARIAEGAGAVAVMALERVPADIRAQGGVSRMSDPDMIEGIIAAVTIPVMAKVRIGHFVEAQILQTLGVDYIDESEVLTPADYAHHIDKWNFTVPFVCGATNLGEALRRISEGAAMIRSKGEAGTGDVSNATTHMRAIGGEIRRLTSMSEDELFVAAKELQAPYELVAEVARAGKLPVTLFTAGGIATPADAAMMMQLGAEGVFVGSGIFKSGAPEHRAAAIVKATTFFDDPDVLAKVSRGLGEAMVGINVDEIAVGHRLAQRGW

SEQ ID NO: 15003 - protein, 199 aa, Pyrobaculum aerophilum str. IM2
MSSKGPSYRIENIVATVNLGVELDLEQLAERLTMAEYNPDQFPGLILRLTKPRISALIFRTGKMVCTGAKNEEDLKNAVRALVKLLKDHGADVPFDPEVQIQNIVASGNLHAEVDLEQAVLMLENAMYEPEQFPGLIYRMSSPRVVILIFGSGKIVCTGAKSEKDVATAVQKLYNQLKELGVLYVEEGGEELEEFEEEL

SEQ ID NO: 15004 - protein, 424 aa, Triticum aestivum
  unsure (1)..(424): unsure at all Xaa locations
MAARAHNNVAAAQQQNRALGGGPAGGKQQKAAMAGRPDPKNTRRALGDIGNVEANNRRAPLGDIANVVNARAAEGKPQPHEPVNRPVTRNFGAQLLKNAQEIAXNPVARPAVRRAHHVKPAPPPPEHVIEISSDSDVTKSEAGSVSSVRKYSRKKVVTTLSHVLSARSKFAAGITEEPAIQDIDKLDGDNQLAVVDYIEDIYKFYKVAENECRARDYMDSQVEINAKMRGILIDWILEVHQKFDLMPESLYLTVYIIDMYLSLQSVLRRELQLVGVSALLIACKYEEIWAPEVNDFILISDSAYTREQILKMEKAILNRLEWNLTVPTPYVFLVRFAKAACSSDHKNDKEMENTVFFFAELALLQYGLVQSKPSMVAAAAVYAARLTLKKTPLWTDTLKHHTGFTEAQLMDAAKILVASHSTGP

SEQ ID NO: 15005 - protein, 402 aa, Triticum aestivum
MEHPAPAPEPMLLDEQPPTAVACEKKQQDGEAPYAEGNDAMTGHIISTTIGGKNGEPKQTISYMAERVVGTGSFGIVFQAKCLETGETVAIKKVLQDRRYKNRELQLMRSMIHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKICDFGSAKVLVAGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNARLPNGRPFPPLFNFKHELANASQDLINRLVPEHVRRQAGLAFVHAGS

SEQ ID NO: 15006 - protein, 360 aa, Lactococcus lactis subsp. lactis
MSWQNNSGSKSLYWQVKQPELTGMIKLNTNENPYPPTSVAQLFNERYKTKNLRLYPSTDAKSLRKKLAEYHHLEVEQVFIGNGSDEVLSLSFLTFFNSQSPLLMPDITYSFYPIYCELYRIPFQKVPVDDDFKVSIKDYCIENGGIVIANPNAPTALALNLKDIEEILKKNQNSIVLIDEAYIDFGGETCLPLLKKYDNLVVVQTFSKSRSLAGIRLGVAYGSAEAISHLYDVKNSFNSYPIDSLAQIIGEASLMDEHYFQKNIQKIIKTREVFKDNLVNLGFEVTDSKANFVFVHHPKVKAEDLFKALYEAKIIVRHWNQPRIDDWLRITIGTNKEMNKVIEFLKGYLKKNEEIDEWKK

SEQ ID NO: 15007 - protein, 360 aa, Aralia cordata
MGSLEAERKTTGWAARDPSGVLSPYTYTLRETGPEDVFIKIIYCGICHTDIHQIKNDLGASNYPMVPGHEVVGEVVEVGSDVTKFKVGDCVGDGTIVGCCKTCRPCKADVEQYCNKKIWSYNDVYTDGKPTQGGFSGHMVVDQKFVVKIPDGMAPEQAAPLLCAGVTVYSPLTHFGLKEISGLRGGILGLGGVGHMGVKLAKAMGHHVTVISSSDKKKEEAIDHLGADAYLVSSDATQMQEAADSLDYIIDTVPVFHPLEPYLSLLKLDGKLILMGVINTPLQFISPMVMLGRKAITGSFIGSMKETEEMLDFCNEKGITSTIEVVKMDYINTAFERLEKNDVRYRFVVDVAGSKLDQET

SEQ ID NO: 15008 - protein, 71 aa, Zea mays
SNTNNRGENENAIKRRGEADARKMERIPKPKEGEGVKRLKLETGAGAAIRVLDHAMDINGPRGRCLPRKAT

SEQ ID NO: 15009 - protein, 456 aa, GIBBERELLA ZEAE PH-1
MVLTVSLVSYLFNISKPTPSSCSLSLQGSKSTYQLDVQWRPSTSKPVLGQISWPSSPIAVRESKLPLPRNRHRDKTNNSHSDYKDDGTNILLDANENAYGPSLSSDVADKTANGVDVDLLGLHRYPDPHQEPLKQLLCELRNTHAHTSKTLKPENLFVGVGSDEAIDALLRCFCIPGKDRILTCPPTYGMYSVSAQVNDVALVKIPLLEAPSFSIDVPAVLNALTNEPNIKLVYLCSPGNPTGSLLAKSDVQQILDHPTWNGVVVLDEAYIDFAPDNASLAEWVAEFPNLVVMQTLSKAFGMAGIRLGAAFTSPPIARLLNSLKAPYNISSPTSALASYAVSEKGLAIMRDHRARLLEQRDRLIQELPKIPGVGRLRGGTESNFMLYEMLNSAGEPDNSIALAVYEKLAEGKGVVVRFRGKEHGCLGCLRITVGTDAEVTRFLDSLKTTLAEVRGS

SEQ ID NO: 15010 - protein, 278 aa, Cetraria islandica subsp. islandica
VEHGAVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 15011 - protein, 338 aa, Glycine max
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVWKVLPALNGKLTGMAFRVPAVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 15012 - protein, 204 aa, Oryza sativa
MADEEHEVYGQEIPLDGEDVDMGAPGDEAAKMQELDEMKRRLKEMEEEANALREMQTKVAKEMQGLDPNASSSESKEEMDARSVYVGNVDYACTPEEVQQHFNSCGTVNRVTILTDKFGQPKGFAYVEFLEVEAVQEAVKLNESELHGRQIKVAPKRTNVPGMKQPRGGRGFGGHPYMRPYGAPFYNPYGYGYPRFRRPRRPYF

SEQ ID NO: 15013 - protein, 309 aa, Glycine max
MAATSTSLASQLYIGLRRPCLKLDSFNSQSFSLFDPNLRLSLSPPKPSRAVIAMAGTGKFFVGGNWKCNGTKDSISKLVADLNNAKLEPDVDVVVAPPFLYIDQVKNSLTERIEISAQNSWVGKGGAFTGEISAEQLKDLGCKWVVLGHSERRHVIGENDEFIGKKAAYALSQGLGVIACIGELLEEREAGKTFDVCFQQLKAYADAVASWDNIVIAYEPVWAIGTGKVATPQQAQEVHVAVRDWLKKNVSDEVASKTRIIYGGSVNGGNSAELAKQEDIDGFLVGGASLKGPEFATIVNSVTSKKVAA

SEQ ID NO: 15014 - protein, 162 aa, Triticum aestivum
  unsure (1)..(162): unsure at all Xaa locations
MAPAVMASSATTVAPFQGLKSTAGLPVSRRSSASLGSVSNGGRIRCMQVWPIXEGIKNSETLSYLPPLSTEXXWKQVDYLDXSKWXPAPXQASWFLSRXXNXSPXYYDGPYWDKXNLPCLXGPHKLNEWRSQEGLTLFPFNCAKWMRQASSNGVRGSGKAKY

SEQ ID NO: 15015 - protein, 296 aa, Streptomyces roseochromogenes subsp. oscitans
MRGILLAGGTGSRLWPVTRAVSKQLIPVFDKPMIYYPLTTLMMAGIREILVITRPEDQRQFRHLLGDGSQLGLRLEYAVQEQPEGIAQAFVLGAEFIGDQSVALVLGDNIFHGGGLGTRLREYSDPVGGRIFAYVVADPTAYAVVEFDEAGMAVSIEEKPADPKSRYAVPGLYFYDNRVVEVARGLVPSERGELEITAVNETYLRWGQLRVTALDRGTAWLDTGTFTSLVQASEYVRVVEERQGLKIGCVEEVAWRCGLIENDQLRELSRPLLKSGYGQYLLDLLAERELKELKVS

SEQ ID NO: 15016 - protein, 670 aa, Bacillus subtilis subsp. subtilis str. 168
MDIFLVVLVLLTIIAISNIVNRFIPFIPVPLIQVALGILAASFPQGLHFELNTELFFVLFIAPLLFNDGKRTPRAELWNLRAPILLLALGLVFATVIVGGYTIHWMIPAIPLAAAFGLAAILSPTDVVAVSALSGRVKMPKGILRLLEGEGLMNDASGLVAFKFAIAAAVTGAFSLAQAAVSFVFISLGGLLCGVVISFLIIRFRLFLRRLGMQDVTMHMLIQILTPFVIYLAAEEIGVSGILAVVAGGITHAVEQDRLESTMIKLQIVSSSTWNIILFILNGLVFVILGTQIPDVISVIFNDTAISNMKVIGYILVITFTLMLLRFLWVLFFWNGKWFFNKDQNIYKPGLRSTLLISISGVRGAVTLAGSFSIPYFLEDGTPFPERNLILFLAAGVILCTLVIATVVLPILTEKEEEDEERNKKLLTARRKLIKTALQTIKEDMNETNKTASLAVIAEYNEKMKNLRFQQYTSSNRIKKHERKVRAQGVKAEQEALMKMLERGDIPEETANVLQERFNELEILYANPFKVGLSKTRLKRLMYWIFFGEHKKPEMSILNEAGLIRATRVKTAKAAIEYLEKHKTDEHKEVFLSVITFYKQLIFRLEHSHHELKSSAHFENQKLEVKLKAVQAIRNEIQTLFEEREISRDISHELRQYINDVEAAMLEGGE

SEQ ID NO: 15017 - protein, 226 aa, Glycine max
MFIESFKVESPNVKYTETEIQSVYNYETTELVHENKNGTYQWVVKPKTVKYEFKTNTHVPKLGVMLVGWGGNNGSTLTGGVIANREGISWATKDKIQQANYFGSLTQASAIRVGSFQGEEIYAPFKSLLPMVNPDDVVFGGWDISNLNLANAMARAKVFDIDLEKQLRAYMESMGPLPGNYEPDFIAGHQRERGNHVIQAQKKNKFHQSFKTFKELKEALKVTKGV

SEQ ID NO: 15018 - protein, 181 aa, Coxiella burnetii RSA 493
MTKKQKPSQNEDLNLTTAQGTPISDDQNSLKIGDRGPLLLEDFPFREKLFHFDHERIPERVVHARGFGVHGYFETDVSLSEITMAHLFQKKGEKTPVFVRFSTVVGSQGSPDLARDVRGFAVKFYTKEGNWDLVGNNIPVFFIQDPIKFPDLIHAAKAEPDRGFPQAQTANDNFWENFRYQ

SEQ ID NO: 15019 - protein, 497 aa, Zea mays
  unsure (1)..(497): unsure at all Xaa locations
ERPGARSRPRQQPANQNPTPRALAHPPPWTAPPPXLPLPQPRPQVYLRRPVPPPGPPVQGAPRVQPFTAGAPSPICPPKPRAAVRAPIPAPGLPAGATSAPAPLAATAEAAAGPPPAATDQAPQPQAGAMPPPTAPAAGXRRGDPSPRHTLNEQNSGEYSQSENNVVETAQGHDKETTPGPVKATKRIKKVKASKHNLISTNTGAIEGNTPSSLSSLKPCRXAGSLSLPTKKFINLLQRAEDGALDLNKAAETLEVQKRRIYDITNVPEGVYLMDKALKKMFRWKGFDIAKPKDRLGPVSSLKEELESLXYPAFRMDDEIWAVKEKLQALALYGEKRNWLYLLKEVINKIPHFQSSNMIAITAPRGTCVEVPAPNADQYMYGNLGLQEKHYKIVLRSSMGPVDCYLISCDHEDIFNQGQLVAADRLKPAVATDSSQDLQQMDCDPNQASNGGCMRAAEPSRKQEIGILRIVPSDADADADYWLASGVDVSMTDAWGT

SEQ ID NO: 15020 - protein, 280 aa, Zea mays
  unsure (1)..(280): unsure at all Xaa locations
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAXQEESEGNLKGILGYVD

SEQ ID NO: 15021 - protein, 135 aa, Zea mays
MISTKRIAQLAKKWQRTEALGRKRLGWGTAAKKADRCCASVASKGHCAVYTTDGARFEVPLACLGTAVFAELLHMSREEFGFAGGHGRILLPCDAMVMEYALCLLRRGASADLEKAFLSTMAMSCHSADHAAAPY

SEQ ID NO: 15022 - protein, 656 aa, Nostoc sp. PCC 7120
MAIFARRIGLNQHSAYGSRQRVIVMKNFGKKALIKQQSPKRVAWTGALAASLIMLPTMFGGNPVLAQKAERESLSYGELIQKVNQEQVKRVELDETEQIAKVYLKGQKPDAPPIQVRLLEQNNELINRLKEKNVDFGEISSANSRAAVGLLINLMWILPLVALMLLFLRRSTNASSQAMNFGKSRARFQMEAKTGVKFDDVAGIEEAKEELQEVVTFLKQPERFTAVGARIPKGVLLVGPPGTGKTLLAKAIAGEAAVPFFSISGSEFVEMFVGVGASRVRDLFKKAKDNAPCLIFIDEIDAVGRQRGTGIGGGNDEREQTLNQLLTEMDGFEGNTGIIIIAATNRPDVLDSALLRPGRFDRQVIVDAPDLKGRLEILQVHSRNKKVDPSVSLEAIARRTPGFTGADLANLLNEAAILTARRRKEAITILEIDDAVDRVVAGMEGTPLVDSKSKRLIAYHEVGHGLVGTLLKDHDPVQKVTLIPRGQAQGLTWFTPNEEQGLISRSQLKARITSTLAGRAAEEIVFGKPEVTTGAGDDLQKVTSMARQMVTKFGMSELGPLSLENQSGEVFLGRDWMNKSDYSEEIAAKIDSQVREIINTCYQTSKELLQTNRVVMERLVDLLTEQETIEGDLFRKIVSESQNPVVDEQLSMVNSQ

SEQ ID NO: 15023 - protein, 165 aa, Aloe vera
SGYSLLRDPHHNKGLAFTDKERDAHYLRGLLPPVCISQELQEKKLMRSLRQYQVPLQRYMAMMDLQERNERLFYKLLIDNVEELLPVVYTPTVGEACQKYGCIFKRPQGLYISLKEKGKILEVLKNWPERSIQAIVVTDGERILGLGDLGSQGMGIPVGKLSLYT

SEQ ID NO: 15024 - protein, 254 aa, Glycine max; identical to SEQ ID NO: 3549

SEQ ID NO: 15025 - protein, 277 aa, Zea mays
MTTKQLRRVRTLGRGASGAVVWLASDEASGELVAVKSARAAGAAAQLRREGRVLRGLSSPHIVPCVGARAAAGGEYQLLLEFAPGGSLADAAARGGGRLAERDIRAYAGDVARALAYLHGRSLVHGDVKARNVVVGGDDRARLTDFGCARPAAAGSARPFGGTPAFMAPEVARGEGQGPAADVWALGCTVVELATGRAPWGDADGLLAAVHRIGYTDDVPEAPAWMSADARDFLARCFERRAAARPTAAQLLAHPFVADLDERPKRQEEGLPSPKST

SEQ ID NO: 15026 - protein, 314 aa, Rumex palustris
MEFPIINLEKVNGDERKATMDMIKDACENWGFFELVNHGIPVEVMDTVERLTKEHYKKSMEQRFKELVASNGLVDASAEVNDVDWECTFHLKHLPDSNISELPDLEDKYRKVMKDFALRLEKLAEDLLDLLCENLALEKGYLKEAFYGARGPTFGTKVANYPPCPKPELIKGLRAHTDAGGIILLFQDDRVSGLQLLKDDEWIDVPPMRHSIVVNLGDQLEVITNGKYKSVLHRVIAQTEGTRMSIASFYNPGSDAVIYPAPELVEDAQEKTQVYPKFVFEDYMKLYSALKFQAKEPRFEAMKADVSMGPIATA

SEQ ID NO: 15027 - protein, 351 aa, Saccharomyces bayanus
MSSQAIPESQKAIVFYETNGKLEYKDIAVPEPKANEILVHVKYSGVCHSDLHAWRGDWPFQLKFPLIGGHEGAGVVVKLGSNVKGWKVGDLAGIKWLNGTCMSCEYCEVGNESQCPHLDGTGFTHDGTFQEYATADAVQAAHLPENVDLAEVAPILCAGVTVYKALKRANLIPGQWVTISGACGGLGSLAIQYATAMGYRVIGIDEGETKKQLFEGLGGEVFIDFTKEKDIVGAVIKATDGGSHGVINVSVSEAAIEASTRYCRPNGTVVLVGMPAHAYCKSDVFNQVVKSISIVGSCVGNRADTREALDFFARGLIKSPIHLASLSDVPEIFEKMEKGEIVGRYVIDTSK

SEQ ID NO: 15028 - protein, 499 aa, Burkholderia fungorum
MTDMTHFDTSLVPTGDIFIGGEWRQGRGNPYTSLYPADQSVNMEISTANADDARDAVEAADIAWRRADWSGLKPHQRALILYRIADLIMARHEALAQLQRRDNGKPIGETRVLVASAANTFRYFAACLETLDEEVTPSRGDYLTMSIYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAADKLMPVSLELGGKSPTIVFDDADLDHAVNGVLYGIFSSSGEACIAGSRLFVQRSIYDTFMKRLADGARKLRVGDPSRSETQMGPLITAAHRETVERYVALGLEEGGRLLCGGERPVGDGREAGTYFQPTILEGLTNNARICQEEIFGPVLVAMPFDDEASLLKEANNSVFGLAAGIWTRDYKRAYRIARALEAGTIWINTYKLFSISTPFSGWKESGMGREKGRLGIREYMQQKSLYWGLNDAPLAWAN

SEQ ID NO: 15029 - protein, 225 aa, Oryza sativa (japonica cultivar-group)
MGRGKVELKRIENKISRQVTFAKRRNGLLKKAYELSVLCDAEVALIIFSTRGRLFEFSTSSCMYKTLERYRSCNYNLNSCEASAALETELSNYQEYLKLKTRVEFLQTTQRNLLGEDLVPLSLKELEQLENQIEISLMNIRSSKNQQLLDQVFELKRKEQQLQDANKDLKRKIQETSGENMLHISCQDVGPSGHASEANQEFLHHAICDPSLHIGYQAYMDHLNQ

SEQ ID NO: 15030 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAARPRIFQ

SEQ ID NO: 15031 - protein, 357 aa, Neurospora crassa
MAARTLKIGLIPGDGIGKEVIPAGRRILEALPASLGLKFEFIDLKAGWETFEQTGNALPEETVSILKSECDGALFGAVSSPTKAVKGYSSPIVALRKKLDLYANVRPVKSVRGPGVKPIDMVIVRENTEDLYVKEEKTYDTPEGKVAEAIKRISQRASSRIATIAGEIALRRQKIREGGSPSIHKGPLVTVTHKSNVLSQTDGLFRSTAREALAAGRFTSVAVEEQIVDSMVYKLFRQPEAYDVIVAPNLYGDILSDGAAALVGSLGLVPSANVGEGFAIGEPCHGSAPDIQGQNIANPIATLRSAALMLEFLNEEEAAAKIYAAVDANLEEGKLLSPDLGGKAKTEEVVQDILRRL

SEQ ID NO: 15032 - protein, 316 aa, Zea mays; identical to SEQ ID NO: 6715

SEQ ID NO: 15033 - protein, 543 aa, Oryza sativa (japonica cultivar-group)
MVAAAVAAAEQVVAALREECATPAARLDGVAAAMAGEMAAGLAEEGGSKIKMIVSYVDNLPNGSLLLGNFLVIVWFLDAMNTLISAATDDSDTLIENKNCGKYLLLFSLLKQQNSGTAMCAVLYFCIKRTEEGLFYALDLGGTNFRVLRVQLAGKEKRVVKRESREVSIPPHLMSGNSSELFGFIASALAKFVADEGHNAVFNDRQRELGFTFSFPVRQTSIASGTLIKWTKAFSIDDAVGEDVVAELQMAMEKQGLDMRVSALINDTVGTLAAGSYYDEDIVVGVILGTGSNAAYLEKANAIPKLEGELPKSGNMVINTEWGNFSSSCLPITEYDEALDKESLNPGEQASFSRRLHTPHMSKIFEKLISGMYLGEIVRRVLLKISLQSSIFGNLDQTKLKTRFILRTPDISVMHHDGTPDLRIVAEKLADNLKITDTSLETRKMVVEICDIVTRRSARLAAAGIVGILRKIGRGVPGDKRKSVIAIDGGLYEHYTEFRQCLETTLTELLGEEASKSVAVKLANDGSGLGAALIAAAHSQYLN

SEQ ID NO: 15034 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 15035 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHRGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 15036 - protein, 473 aa, Ceramium kondoi
YESGVIPYAKMGYWDPEYVVKDTDVLALFRVSPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLESYLKIDLPKGIFFEQDWAALRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVETPTANV

SEQ ID NO: 15037 - protein, 765 aa, Glycyrrhiza glabra
MWRLKIAEGGKDPYIYSTNNFVGRQTWEYDPDGGTPEERAQVDAARLHFYNNRFQVKPCGDLLWRFQILRENNFKQTIASVKIGDGEEITYEKATTAVRRAAHHLSALQTSDGHWPAQIAGPLFFLPPLVFCMYITGHLDSVFPEEYRKEILRYIYYHQNEDGGWGLHIEGHSTMFCTALNYICMRILGEGPDGGQDNACARARKWIHDHGGVTHIPSWGKTWLSILGVFDWCGSNPMPPEFWILPSFLPMHPAKMWCYCRLVYMPMSYLYGKRFVGPITPLILQLREELFTEPYEKVNWKKARHQCAKEDLYYPHPLLQDLIWDSLYLFTEPLLTRWPFNKLVREKALQVTMKHIHYEDETSRYITIGCVEKVLCMLACWVEDPNGDAFKKHLARVPDYLWVSEDGMTMQSFGSQEWDAGFAVQALLATNLVEEIAPTLAKGHDFIKKSQVRDNPSGDFKSMYRHISKGSWTFSDQDHGWQVSDCTAEGLKCCLLLSMLPPEIVGEKMEPERLYDSVNVLLSLQSKKGGLSAWEPAGAQEWLELLNPTEFFADIVVEHEYVECTGSAIQALVLFKKLYPGHRKKEIENFIANAVRFLEDTQTADGSWYGNWGVCFTYGSWFALGGLAAAGKTFANCAAIRKAVKFLLTTQREDGGWGESYLSSPKKIYVPLEGSRSNVVHTAWALMGLIHAGQAERDPAPLHRAAKLIINSQLEEGDWPQQEITGVFMKNCMLHYPMYRDIYPMWALAEYRRRVPLPSTPVCLT

SEQ ID NO: 15038 - protein, 469 aa, Glycine max; identical to SEQ ID NO: 10891

SEQ ID NO: 15039 - protein, 105 aa, Triticum aestivum
MSTPGGEEDKKPASAGGEGGGAHINLKVKGQDGNEVFFRIKRSTQLKKLMNAYCDRQSVDMKAIAFLFDGRRLRAEQTPDELEMEDGDEIDAMLHQTGGRLPPSA

SEQ ID NO: 15040 - protein, 498 aa, Micrococcus luteus
TTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPKNHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 15041 - protein, 204 aa, Amaranthus powellii
AIQVLDELTKGDAVVSTGVGQHQMWAAQFYKYRNPRQWLTSGGLGAMGFGLPAAIGAAVARPDAVVVDIDGDGSFIMNVQELATIRVENLPVKIMLLNNQHLGMVVQWEDRFYKANRAHTYLGNPSNSSEIFPDMLKFAEACDIPAARVTKVSDLRTAIQTMLDTPGPYLLDVIVPHQEHVLPMIPTGAAFKDTITEGDGRRAY

SEQ ID NO: 15042 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 15043 - protein, 214 aa, Bifidobacterium longum DJO10A
MTDSAHILVVDNYDSFVYTIVGYLQTLGATVDVVRNDAIDPAAPGVLDGYDGVLISPGPGAPAESGASEDMIRLCAASGVPMFGVCLGLQALAEVYGCTVDHAPTIMHGKTSLVEHIDDEIFEGVANPMTATRYHSLAVEPDSVPDTLVVTAWTQGDHIIQGVRVKGKPMYAVQFHPESVMTQDGYRLLANWLKVCGQDNAVAKSAGLQPKVTK

SEQ ID NO: 15044 - protein, 448 aa, Clostridium thermocellum ATCC 27405
MAKGGFLRMSYNIKIKEVLEFVEENDVKFIRLAFCDILGIPKNISIMPQELERAFEQGISFDASSILGFMNVEKSDLFLHPDPSTLSILPWRPQQGRVIRFFCDIKHPDGSAFEGDSRNILKKAVERAEKMGYACRIGSECEFYLFETDEKGRPTYIPHDEGGYLDMAPLDKGENVRREICLSLEQMGIQPESSHHEQGPGQHEIDFKYSDALTAADDLMTFKTVVKAVASRNGLFASFMPKPILTESGSGLHINISLSKDGFNIFKERNYDSSAAKSFIAGVIDKILDITAFANPITNSYARLGSFRAPKYVSWSHQNRSQLIRIPAETGEYSRMELRSPDPACNPYITFALILHAGLDGIERKLELPGPINQNLYNAGADELQNIKALPQNLKEALDVASKSSFVRNILGEEMLSKYLEIKLKEWNMYFESEDRESVEKQMYFKII

SEQ ID NO: 15045 - protein, 416 aa, Zea mays
MAAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVPAPPAEDLNGKHEPKSPKAAPRSPKAATHPTFATSVKKPIGAKKVGGKTGGLGVRKLTTKPNESLYEQKPEEPKPAVPALAASTKKGGQALHSRFEYVENEPSADSRTGGSVSRVSGHVAPPKSSDFFQEYGMGNGFQKKSSNASKTQVEETDEARKKFSNAKAISSSQFFGTQNREEKEAQLSLQKFAGSSSISSADLFGRNDADNSNLDLSAADLINRISFQASQDLSSLKDIAGETGKKLTSLASNFISDLDRIL

SEQ ID NO: 15046 - protein, 348 aa, Saccharomyces cerevisiae
MSIPETQKAIIFYESHGKLEHKDIPVPKPKANELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 15047 - protein, 476 aa, Oryza sativa
PLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICLAINLLVPLRMPDDKLEVGDDAVHGEEAYALWGDGEMYDVTKHVQLLINDLESGNEFSEEKAKGAIIYNY

SEQ ID NO: 15048 - protein, 335 aa, Brucella melitensis 16M
MAVRVAINGFGRIGRNILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLYGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 15049 - protein, 304 aa, Bacillus cereus ATCC 14579
MHNKKWDLRIICAHAFTILIWGTAFPAIRMGLESYTPEHLTLLRLLIASFILLLFSFIYKLRLPDLKDIPAIFIFGALGFTIYHIALNYGEKTVNAGSASLIISVTPIVTAILASVFLNEKMKLNGWLGGVISFAGIALISFSQGDAIQLNSGGLFILLAAISESLFFVFQTSYLKKYGFLPFTIYTILSSTVCMLIFLPGVYQEILAAPLEVNLSVIYLGVFPTVLPYIALAYIISRAGASEATSSLYLTPITACFIAWIWLGEVPTLVSIIGGGITILGIVIAHIPVLRKEKHRNLANNQSV

SEQ ID NO: 15050 - protein, 352 aa, Zea mays
  unsure (1)..(352): unsure at all Xaa locations
MMASQAMVPLRQLFVDGEWRPPAQGRRLPVVNPTTEAHIGEIPAGTAEDVDAAVAAARAALKRNPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 15051 - protein, 423 aa, Xanthomonas axonopodis pv. citri str. 306
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 15052 - protein, 352 aa, Triticum aestivum
  unsure (1)..(352): unsure at all Xaa locations
RGRVDLERPLKLAKEAIGIVYVSPYEVATCPLCCEERRGSHMIKVGCSHKFCYSCLIVYVEGRLHASKLPIRCPQLRCKYHISAGECKSFLPVSSYESLERAFAVGGSTYDMEGLYRPYPNCSVSLDLSQHFSRAAHASAHASDCIECPECHRDICINCGVPWHIMMGCDEYQSLPVEEGGAGDLSLHRLAQNNSWRRCQRCRRMIELTQGCFHMTCWCGHEFCYSCGAEYNNGVQACQCVFWDEDNAEPSAAQSCQASEIWAWDTFDCMPTAADGYSEQERAQLALTQRFXLGGGFSLSGDHHHLSQQSLPPRCXEDSYHRRPIXKDLHQLPWLERFVSVMSDTYNDDYIQ

SEQ ID NO: 15053 - protein, 303 aa, Streptomyces avermitilis MA-4680
MIVVAGEALIDLVPQGAGALAGLKPALGGGPYNTAVALGRLGSPTAFCSRTSRDAFGEALLDGLRTAGVDVSAVQRGAEPTTLAVATIDEHGSAAYSFYVDGTADRQFAAPDRLPGATRAVSFGTCSLVLEPGASAYEELLRSAAAQGLFTTLDPNIRAGLIPDPDAYRARFKSWLASVTLLKLSEDDATWLGGSPREWLASGPSAVVLTRGGDGLTVFTRDGAEHSVPGEPVDVVDTIGAGDTVNAALLHGLAARDALSPEGLAGLDAEGWTELLRFAARAAAITCSRAGAEPPYASELGAF

SEQ ID NO: 15054 - protein, 1227 aa, Neurospora crassa
MVPYYRKTWRDFIDSTRDAIAELGAEIGISDEPERRVRCDKMVFAHYMLGLTLNHTARDWEDEIRAAKECGIDGFALNTGSQDHWLDEQLSLAYQAAERAGGFVLFISFDFAFEWTVQQVVDLINRFKYSPAQCVVDGRPFVSTFEGPQWAENWPIVRQATGGIFLVPDWASLGPHGVAQKLDIIDGAFSWDAWPKGCNHKMGPDEDHLYLQALQIEKPGIFGTPNNKHKYMMGVSPYFYTNLPQWNKNWYCSSESLCYIYDPHRDDQIVPGADAYVKGHSHDAYRAILPHFIQAYKAGKTKAKPREHLEDVAIAWYRRTPASAGHHGETVWGQGGDALAAHGVKDVISVVAITKEENTVTVTLGDGQPREFQTARGSSYFEIPFDETTLGPVRLQLNGQVTEGPDIHCNCEDKIRPINARKRWHAPLNGGRALPGKPVCYVTGDLSVNPGHSPTGHIDQATTSRRFPPDLNHVTYNNNNTNNARKDLRIPRTLGLPLKRYRQTFFPPTQTDRSSSRQRPGADGVTPSRLITCPPCGWQPSPLAGSLVARNRHRHSRPQQGGVPVFFHTTFYGHRRNNRYALLLVFLLQPGQYHVPRDHDYHRHGKRQEEEEEEQGKKEQDMRMLQVSREEIEKKVGEDVTGLKRIGKKIVLFLDFYIWEPLCTGIRFLKLVAIFAPVIITVPVIWFGERQPDRDDERSGTLWWYGFLVQAMEWAGPAFIKLGQWAASRSDIFPDEMCNIMSKLHDDAPAHSLHATKRIVEAAFNGRHFDEIFEEFDEKPLGVGAIAQVYRAKLKPDLTMPADADLSSSTHRFVKNVGTVLKATPKRVPSSHVAIKVLHPGVERTVRRDLRIMRFFASMINAIPTLEWLSLPDEVDQFGDMMKLQLDLRIEAANLSRFRKNFKDRTTAWFPYPYTEFSTRNILVEEFAHGVPLADFMANGGGVFQHDIASEGLDAFLRMLLLDNFVHADLHPGNIMVRFYESEKPPLSLHWDKPSDANPAGKNGDVTEKVLSRLWPYRNNKELWIAELEKIDEEGYRPQLIFIDTGLVTELNATNRRNFLDLFRAVAEFDGYKAGHLMCERCRQPDAVLDKEVFALKMEHLVRDVKNKTLALGNIKIGDILEKVLNMVRQHHVRLEGDFVNVVISILLLEGIGRALDPDVDLLSSSLPILRQLGAQGGKDMLMEGDVHMMAVWLGLEARRFMQASIEDVERLHMYSFGFLGPRRTTI

SEQ ID NO: 15055 - protein, 387 aa, Streptococcus mutans UA159
MVTVVVPAHNEDVVIAQTAKAILDMKYPRDKLEIILFADNCEDNTYQEMQSIKALPQYADRDLTLINRSGTGGKAGVLNDALKIAKGDYICVYDADAMPEKNALYFLVQKVMEDPERHVAAFGRNKTRNANQNFLTRCINQEIVVTQRIQHVGMWHLGKIGRIPGTNFIINTEFVKSIGGWRNGALTEDTDISFKIMQSGKLIALAYNSEAFQQEPETLKSYYLQRKRWAKGNYEVVIANFKHLFGRGNWRVKWEVFYYTCTFFWFNAAIVLSDILFFSNLIALIIGLFKPGVQVPFAFDANNIYMAQLLLFNWFLMILLYLLQISISQATQYGQATVKQIWIALLAYFTYTQLFIIVSISSVASVMMDKILHREGTKWVKTKRFAG

SEQ ID NO: 15056 - protein, 328 aa, Petunia integrifolia subsp. inflata
MAVNGVSSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 15057 - protein, 333 aa, Streptomyces avermitilis MA-4680
MHSSTERSPGSLRTSYAQQVATVALTALAPASWGTTYAVTTELLPPGHPLFAGLMRALPAGLLGLAITRVPPRGDWWWKAAVLGVLNIGALFPLLFLAAERLPGGVAATLSATQPLLVAGLAIAVLRDRPTAWRWTWGAIGVIGVGLVVLGPQARLDGVGVLVGLGGTAAMVGGVVLTKRWGRPAEVGPLTLAGWQLTAGGLLLLPLTLAIEGVPQRIDAGAVGGYLWLGSMGGLIAYTLWFRGIGKLPVGVSAPLVLLSPLVATLVGIVLGESLGLPQTLGFVLALAALLATQLNAPNVFGRIARGGPAEDPIPDRIPDPSREDQIRGGRIR

SEQ ID NO: 15058 - protein, 189 aa, Zea mays
  unsure (1)..(189): unsure at all Xaa locations
VQQRALAPAPDKPASAPKGNSAELKKKTXALLEEYFSIRILEEAQTXIEELQNRGYYPEIVKEAVNLALDKGTNFVDPLVRLLEHLYTKKIFKTQDLESGCLLYGALLDDIGIDLPKAPTQFGEIIARLTLLGALRFEVMEEILKKMEDTMYRKAVFDAVKKTLEANPSGQTILGSHAAVIDACNSLLE

SEQ ID NO: 15059 - protein, 422 aa, Gracilaria caudata
RYESGVIPYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLEVNLPQGIFFEQDWASLRKVTPVASGGIHCGQMHQLLDYLGNDVVLQFGGGTIGHPDGIQAGATANRVALEAMVLARNE

SEQ ID NO: 15060 - protein, 427 aa, Batrachospermum helminthosum
  unsure (1)..(427): unsure at all Xaa locations
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGRDFVNEGPQILRDAAKTCGPLQTALDLWKDISFNYTSTDTAXFV

SEQ ID NO: 15061 - protein, 484 aa, Petalonia zosterifolia
VQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLIITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAATTCGPLKAALDLWKDITFDYTSTDTPDFVEVATGSR

SEQ ID NO: 15062 - protein, 234 aa, Zea mays
  unsure (1)..(234): unsure at all Xaa locations
FLTPISGVTALNLLKENPISPPPRCARRYDSRTXTIFSPEGSLYQAEYAMEAIGNDGSALGMLVGDVVVLSXDKKVTSMLVETSRSVYKMYKIDSHLSCAVAGIXSDAYILIITARLHAQSYAFSYEXPIPVEQLVXSALCDTKXDYTHFGGLRPFGVSXFLFAGRDEHHGIQVYMSDPSGNYVACKDAAVAVNRQAAQSMLEQDYKDALTRDEXVGLELIXVSKTVDSTSLTA

SEQ ID NO: 15063 - protein, 470 aa, Porphyra conwayae
SVIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 15064 - protein, 513 aa, Oryza sativa (japonica cultivar-group)
MAGGAMTDTDGAHKNYPGKMTIFVFLACLVASSGGLIFGYDIGISGGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKVEITSTV

SEQ ID NO: 15065 - protein, 192 aa, Buchnera aphidicola
MNDILLLDNIDSFTYNLVDQLRINNCNVIIYRNTVSISIILKKLSKMCNPILILSPGPGHPDNAGCMLKLLKIVCGKIPIIGICLGHQAIVKTYGGNIENSGEILHGKTSFIEHDGQAMFHNIPNPFLVARYHSLVCNDVPNSLTISAHCDGAVMSVRSDKEKICGVQFHPESILTTLGSKFLKQTVEWAIQ

SEQ ID NO: 15066 - protein, 294 aa, Lycopersicon esculentum
MTYMFKYDSVHEQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYSSRVIDLVCHMAKA

SEQ ID NO: 15067 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGAGGLGRLAACFLDSMATVGQSATGYGLNYQYGLFRQSFVDGKQVEAPDDWHRSNYPWFRHNEALDVQVGIGGAVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAAR

SEQ ID NO: 15068 - protein, 488 aa, Vaucheria synandra
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPFLGATVKPKLGLSGKNYGRVVYEGLRGGLDFLKDDENINSQPFMRWRERFLYCMEGVNRAAAATGEIKGSYLNATAGTIEEMYERAEYAKKLGTIIVMIDLVIGYTAIQSMAIWARKADMILHLHRAGNSTYARQKNHGINFRVICKWMRMAGVDHIHAGTVVGKLEGDPLMVKGFYNTLLQTKLEINLPQGLFFEMEWAALRKVVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATQSK

SEQ ID NO: 15069 - protein, 345 aa, Yersinia pestis CO92
MKYIKLTVLAGIFVGISSPVFALPNITLLATGGTIAGGGDSATKSNYTAGKLGVDALVEAVPAIKDIANIQGEQVVNIGSQDMNDDVWLTLAKKINKDCTKTDGFVITHGTDTLEETAYFLDLTVNCDKPVVIVGAMRPATALGADGPLNLYNAVVVASDADSAKRGVLVAMNDMVFTGRDVVKTNTTSVQTFQSPNTGPLGYIYDGKVNYLHQPAARQLAFDISKLNTLPKVGIIYNYANASDIPAKALIADGYQGIVSAGVGNGNLYHTVFDTLATAASHGVAVVRSSRVPSGSTTEGAEIDDAKYGFVAAGALNPQKARVLLQLALTQTQKPQEIQKLFHTY

SEQ ID NO: 15070 - protein, 432 aa, Rhodospirillum rubrum
  unsure (1)..(432): unsure at all Xaa locations
MTNPARARTLPAGASLPALALLVLAGLGLGAPAIAQESLASPLPGPLTDPALWPVPLPLLMQGLLVMGLLAGLTLFQSGLVRPGASGAQAIKGICGSALAVLAFFFIGSNVLMVGVNGGFHGTFAFFPLPVEGATPDAMAEWFLRAPFAALPVLIVAGALAERLRLWPFMIFAVVLAAVLGPIAGSWSWGGGWLDRLGFVDIGGATVLHSAAGWXXXXXXXXXXXXXXXXXLPTNSLALATFGTFAGWIGWFGLTGGAVLLAVPEAGPAILVPTYVNTLLAGAAGLAVALIVSLIVGRNGVMARGLQGALAGLVSISAAPHLPMPLVALAIGAIGGLLVVIAVPLIERLRIDDATGAISVHLICGLWATLVVSVIDPTVPLTTQALGAAAVGGAMVLASFVVWLAIKLTLGLRIAFEDESGAQEHRDLGLDV

SEQ ID NO: 15071 - protein, 427 aa, Rhododraparnaldia oregonica
LEASAAIAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGTIVERERMDKFGRPFLGATVKPKLGLSGKNYGRVVYEGLKGGLDFLKDDENINSHPFMRWRERYLFSMEGVNRAQAAAGEIKGHYFNVTAATMEDMYERAEFAKELGSVICMIDLVIGYTAIQSMAIWARKTDMILHLHRAGNSTYSRQKIHGMNFRVICKWMRMAGVDHIHAGTVVGKLEGDPLMIKGFYNTLLESHLEINLPQGIFFEQDWASLRKVTPVASGGIHCGQMHQLLDYLGDDVVLQFGGGTIGHPDGIQAGATANRVALESMVMARNEGRDYVNEGPQILKDAAKTCGPLQTALDLWKDITFNYTSTDTADFV

SEQ ID NO: 15072 - protein, 223 aa, Campylobacter jejuni subsp. jejuni NCTC 11168
MIFAANLKCNHTRASFKIYAKILNKTMGVKCDDIIVFPPSIAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 15073 - protein, 310 aa, Leptospira interrogans serovar lai str. 56601
MAEDKSKFFFVFNNREFMKKVSEIYGSAKGPVYSFEFFPPKTPEGDSKLMETVKELSLLNPDFVTVTYGAGGSTRDKTVQILSQISKDYSFPTVSHFTCVGANKNQILETLKGIRSSGILNLMALRGDPPKGEGEFKKVENGFGNATELVSFIRSEKLDFCIGGGCYPEKHPNAKTLEEDVENLKLKVDAGTDFLVSQLFFVNSIFENFLNLVRKVGIQVPVIPGIMPITSFSQIDRFRSMAGCEFPSSLIQDLQEVEHRPEEFYRRSLNFSVKQCRELLAMGVPGIHLYTLNQSHASYDIVRELKGESV

SEQ ID NO: 15074 - protein, 468 aa, Phyllariopsis purpurascens
IPYAKMGYWDADYNVKHTDILALFRITPQPGVDPVEAAAAVAGESSTATWTVVWTDLLTACDIYRAKAYRVDPVPGTNDQYFAYVAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAADTGEVKGSYLNVTAATIEQMYERAEYSHAIGSVICMIDLVIGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVPTGSN

SEQ ID NO: 15075 - protein, 361 aa, Triticum aestivum
FQPQEDFLKLTVPHFKGKEDVGLVQARWSFVNKDENLLTRLQNINLCFHFEVEQQVNGAFLNFFGFNGTAGVWRIKALEDSGGWMERTTVEDMDIAVRAHLKGWKFLYLNDVECQCELPESYEAYRKQQHRWHSGPMQLFRLCFVDIIKSKIGFWKKFNLIFLFFLLRKLILPFYSFTLFCVILPMTMFAPEAELPAWVVCYIPATMSLLNILPAPKSFPFIVPYLLFENTMSVTKFNAMISGLFQLGSAYEWVVTKKSGRSSEGDLVALVENEKQSKQQRVGSAPNLDSLAAKEELYPKSEPKKKKHNRLYRKELALSFLLLTAAARSLLSVQGIHFYFLLFQGVSFLVVGLDLIGEQVE

SEQ ID NO: 15076 - protein, 618 aa, Mycobacterium tuberculosis CDC1551
  unsure (1)..(618): unsure at all Xaa locations
MSAPTKPHSPTFKPEPHSAANEPKHPAARPKHVALQQLTGAQAVIRSLEELGVDVIFGIPGGAVLPVYDPLFDSKKLRHVLVRHEQGAGHAASGYAHVTGRVGVCMATSGPGXTNLVTPLADAQMDSIPVVAITGQVGRGLIGTDAFQEADISGITMPITKHNFLVRSGDDIPRVLAEAFHIAASGRPGAVLVDIPKDVLQGQCTFSWPPRMELPGYKPNTKPHSRQVREAAKLIAAARKPVLYVGGGVIRGEATEQLRELAELTGIPVVTTLMARGAFPDSHRQNLXMPGMHGTVAAVAALQRSDLLIALGTRFDDRVTGKLDSFAPEAKVIHADIDPAEIGKNRHADVPIVGDVKAVITELIAMLRHHHIPGTIEMADWWAYLNGVRKTYPLSYGPQSDGSLSPEYVIEKLGEIAGPDAVFVAGVGQHQMWAAQFIRYEKPRSWLNSGGLGTMGFAIPAAMGAKIALPGTEVWAIDGDGCFQMTNQELATCAVEGIPVKVALINNGNLGMVRQWQSLFYAERYSQTDLATHSHRIPDFVKLAEALGCVGLRCEREEDVVDVINQARAINDCPVVIDFIVGADAQVWPMVAAGTSNDEIQAARGIRPLFDDITEGHA

SEQ ID NO: 15077 - protein, 276 aa, Oryza sativa
  unsure (1)..(276): unsure at all Xaa locations
MATAARXLPKIQSPASPAVAEARRRXPSSLRLGVTSGPARTLKQKLVAKSAVSVVEGENAFDGVKQDTRPIIVIDNYDSFTYNLCQYMGEVGANFEVYRNDDITVEEIKKISPRGILIPPGPGTPPRXSGLSLQTVQDLGPXSTPLFGVXXMGLQCIGEAFGGKVVRSPYGVVHGKGSLVHYEEKLDGTLFSGLPNPFQAGRYHSLVIEKDSFPHDALEITAWTDDGLIMAARHRKYKHIQGVQFHPESIITTEGRLMVKNFIKIIEGYEALNCLP

SEQ ID NO: 15078 - protein, 303 aa, Oryza sativa
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKKDSQLHSFARARWRNWIGIGWQEYLSPVLRSPDKGVVRYGRGDSRRETCLHVWRSLLSRAPSIPPGSKGRPLLRFCLPLQFYYCCPYRVRLASVYLKQSHINSAHHSLR

SEQ ID NO: 15079 - protein, 255 aa, Klebsiella oxytoca
MNVTICTIGELLVEFLAKEESQGFSRPGEFWGPYPSGAPAIFADQVAKLGLGSVLFSCVGNDAFGEMNIARLESDGVNVNGIAMLQKATTGSAFVSYRSQAQRDFIFNMPNSACGLLTADHIDDRLLNQCNHFHIMGSSLFSFRMIDAMRKAIENIKARDGTVSFDPNIRKEMLNIPEMSQAFEYILDYTDIFLPSDGELDYFGLNPGRDEQVLVDKLKRGVKHVVIKRGPRGASYFSARETHHVTGFHVPVVDP

SEQ ID NO: 15080 - protein, 229 aa, Glycine max
  unsure (1)..(229): unsure at all Xaa locations
MTSAVPVDQINNVTAQVTGDSFSREHLRKQTRIQRISPYEVLSAGLGCTRVDIVKSDAIENRYGPRREVMEALGSRQFTYVSPXDPETRRVRAPLARDSGLEDAYINAGCGADELTDLIFRCVLXAGDKIVDCRGPSTRYESDCSXVNGAVVIKISAWNVEQLGEVVDQVKTKCILXSSPNSADGSIREDEIVLKILEVPIWVIMGEAHTEFSANVSRMSWVGKHDNYV

SEQ ID NO: 15081 - protein, 541 aa, Zea mays
MATANGSWVPRGRAGIHLSITTTSSFPRLPSALRVARGSMATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 15082 - protein, 587 aa, Porphyridium sp.
MTHIEKSNYQEQTGAFALLDSLVRHKVKHIFGYPGGAILPIYDELYKWEEQGYIKHILVRHEQGAAHAADGYARATGEVGVCFATSGPGATNLVTGIATAHMDSIPIVIITGQVGRSFIGTDAFQEVDIFGITLPIVKHSYVIRDPRDIPRIVAEAFSIAKQGRPGPVLIDVPKDVGLETFEYQYVNPGEARIPGFRDLVAPSSRQIIHSIQLIQEANQPLLYVGGGAITSGAHDLIYKLVNQYKIPITTTLMGKGIIDEQNPLALGMLGMHGTAYANFAVSECDLLITLGARFDDRVTGKLDEFACNAKVIHVDIDPAEVGKNRIPQVAIVGDISLVLEQWLLYLDRNLQLDDSHLRSWHERIFRWRQEYPLIVPKLVQTLSPQEIIANISQIMPDAYFSTDVGQHQMWAAQFVKTLPRRWLSSSGLGTMGYGLPAAIGAKIAYPESPVVCITGDSSFQMNIQELGTIAQYKLDIKIIIINNKWQGMVRQWQQAFYGARYSHSRMEDGAPNFVALAKSFGIDGQSISTRQEMDSLFNTIIKYKGPMVIDCKVIEDENCYPMVAPGKSNAQMIGLDKSNNEIIKIKE

SEQ ID NO: 15083 - protein, 499 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWFDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 15084 - protein, 340 aa, Boea crassifolia
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 15085 - protein, 205 aa, Zea mays
ICGTGPPLENEGVDRIFGVPGEENLDVVESLRNSSIKLILTRHEQGAAFMAATYGRLTGKPGVCITTLGPGALNLTTGAAYALLGAMPMIMLTGQKGIMSSRQAKFQIVDVVSAFKPLTKLSLQIVSTSSIPTIVRDAFRIAMEERPGPVLLELPEDIAGEEAEDVAMVAQHPIEIPVAHRASLDRAAEMILKAKRPLIMLGAAA

SEQ ID NO: 15086 - protein, 303 aa, Oryza sativa
  unsure (1)..(303): unsure at all Xaa locations
MAGMSLQHPWAFAFGLLGNIISFMTYLAPLPTFYRIYKSKSTQGFQSVPYVVALFSAMLWIYYALLKSDECLLITINSAGCVIETIYIXVYLVYAXKKAKMFTAKLLLPGNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPEEDDKAAAATAAAVAGAGEKKVAA

SEQ ID NO: 15087 - protein, 726 aa, Guillardia theta
MFFILPKPALRVYKNFKNIVLYDKKNVHNLSKNGKSVQKYYNNIIYLYKNIKVKEKFTNLKIIFFLLLLVDLTIGNSEKIFLDKKKINLSMNDNTIVKNENVKNYDIKNNSNLLFIDITPLNVINDKFYEIIKEMDHHVSRPVKDALILLLATVFVVPLMRKFNTSPILGFLAAGLFLGPNGFGLVHRIGASKTLAEFGVVFFLFEMGLELSLSRLKSLGMDVFGLGYLQWLITGFILAFISLCNNASIEISLVIGFGLALSSSAFVLQLLSERGEVGTRFGRASFGILLFQDLAVVPLLVVVPLLATGGGDFTSLMNALILAAGKAAVALGIIFLGGRTCLEPVFRFGASAKSPEAFVATILVTVLAMSTLTESLGLSDTLGAFLAGVLLAETKYRHQIEADIAPFRGLLLGLFFITVGFGIDISLISGNFLTVITMLITLLVIKASIITTLGFFFGINFASAQRTGLILAQGGEFAFVTFGLAQKSNLMSPQLSQLLFLIVALSMVMTPFLATTGFKIASSIESKRGLMGARKEDIANAKDYVVVAGFGRVGQSVCDLLNARLIRYMAFDMNPARVIEARNKGLPVFFGDACRPEVLKAAGIKNPKAVVVTLDDKDGASKAVNALRREYPSIQIFVRAKDAKHQKMLQLGGATAIVPELLESSLLLGGAVLLSYGTPIEEVNSLIEEARKKTLIDAGLDVTGLTNFSSHNKNDDKKSDNDCNEN

SEQ ID NO: 15088 - protein, 286 aa, Glycine max
  unsure (1)..(286): unsure at all Xaa locations
MEKEYLIIQYSPFMPSFAEIEINPCIITSEKSRKVAVMASEENEXPTWIXNNGPYVVVXNPLDGSRNIDASIPTGTIFGIYKRLEELDNLPTEEKAMLNSLQSGSKLIAAAYVLYSSATILCITFGSETQAFTLDHSTGDFILTNPSIKIPXRGQIYSVNDARYFDWPEGLRQYIDPVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 15089 - protein, 495 aa, Aspergillus niger
MSSALLDEAARIARQFDYPAAEVQRGVTEYIREIDEGLSKEHTTLSQIPTYVTAVPNGTEKGLYLAVDLGGTNFRVCSIDLHGDTTFSLTQSKIMIPRETMASGTAKDLFLFLARQIESFLRIHHNDHFEAHLRRRNEKNGNCEEDLFDLGFTFSFPVRQLGINKGTLIRWTKGFNIPDAVGKDVCALLQNAIDDLGLPVRVAALVNDTVGTLMARSYTSPGETGTFLGAIFGTGTNGAYVEKLDRITKLQTIEHSEYDKTTGEMIINAEWGSFDNHLSVLPNTIYDQQLDADSNNPGIQMFEKRVSGMFLGEILRRVMLDMQRNESLGFLRAGGASTVSVPQESSLYRQWGIDTSLLSLVEADKTENMEQIKVALKDHLKIERPTTDDCKAIQTVVHAIGKRAARLSAVPLAAILLSTGKLQKDDLVDIGVDGSLVEFYPNFEGYMRDALREVPEVGEAGNKKIRIGISKDGSGVGAALIALVASKEETRRKSQ

SEQ ID NO: 15090 - protein, 93 aa, Zea mays
MSGAGEEDKKPAEGGAHINLKVKGQDGNEVFFRIKRSTQLKKLMNAYCDRQSVDMNAIAFPGLMAAGFRGEHTPDELVNGGLLSRSAPCFFGT

SEQ ID NO: 15091 - protein, 492 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLPAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGRSNHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLVPNYLLLPVNAPRAPHHNNHHEGFMNFMHRDEEINYFPSRFDPVRNAEGWLPCRVPLSGRREKMVIAKENNFMQAGARWRAFDAARQERFVVRVADMLADPRCTQEIRRIWVGYWSQADPQLGAGIAAKLQGRGCL

SEQ ID NO: 15092 - protein, 249 aa, Zea mays
MGKHGHGKCHDVEACYPPGAAGGGKYPYMTENPQLRWAFIRKVYVIVCLQLLLTVAVAATVNLVRAIGDFFLSRTMGAMFAIIGVIVAPILVMIPMIIYRKRHPVNLALLALFTVCISFAVGLSCLTANGPVILEAVVITMVVVLGLTFYTFWAAKRGYEFEFLGPFLVSACLILMLFSLLRIIFPLGRTGTMVYGCIAALVFSGFIIYDTDNLIRVYSYDEYVAAAIELYLDIINLFQAILAVLEGVD

SEQ ID NO: 15093 - protein, 566 aa, Xylella fastidiosa Ann-1
MLAAAMRGMAVTFFSQFMVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAEGMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 15094 - protein, 282 aa, Glycine max
MDSLCCFSSFSQVVGGRSSCNSGKGKSSQSSVKYGYSLVKGKANHPMEDYHVAKFVQFEGRELGLFAIYDGHLGDSVPAYLQKHLFSNILKDEDFWNDPFMSISNAYETTDQAILSHSPDLGRGGSTAVTAILINNQKLWVANVGDSRAVVSRGGVAGQMSTDHEPNTERGSIETRGGFVSNMPGDVARVNGQLAVSRAFGDKNLKTHLRSDPDIQYTDITPDVELLILASDGLWKVMANQEAVDVARRIKDPQKAAKQLATEALNRDSKDDISCIVVRFKG

SEQ ID NO: 15095 - protein, 337 aa, Craterostigma plantagineum
MAKVKIGINGFGRIGRLVARVALVRDDVELVAVNDPFITVDYMAYMFKYDTVHGQYKHHELKVKDEKTLLFGDKPVAVFGLRNPEEIPWAETGAEYVVESTGVFTEKEKAAAHLKGGAKKVIISAPSKDAPMFVVGVNEKTYTPDIDVVSNASCTTNCLAPLAKVIHDRFGIVEGLMTTVHSITATQKTVDGPSSKDWRGGRAASFNIIPSSTGAAKAVGKVLPDLNGKLTGMAFRVPTVDVSVVDLTVTLAKEASYDEIKAAIKEESEGKLKGILGYTEEDVVSSDFVGDSRSSIFDAKAGIALSKKFVKIVAWYDNEWGYSSRVVDLIRHMAAAK

SEQ ID NO: 15096 - protein, 304 aa, Desulfovibrio desulfuricans G20
MARHAARKALPAAADGVSVGAVHRNLRYVMASISVRQAGCYYYPHRHAKSHTTSDHADIRGAACYAGSNIRHNSCPFHHAVRSVSKETYMEFFLDTADLDEIRLAGKQGLIDGVTTNPTLLSRQGGDWKKRMQQICDEVDGPVSLEVISPDAEGMLREAEELVRYGDNVVIKVPMTAEGLIATRTLTGKGIKTNVTLVFSAMQALLAAKAGATYVSPFLGRLDGIGHEGMEIVSQIRTIFDNYGYETKILAASIRHAQHVLDSALVGADVVTVPYSVLRQLMHHPLTDSGLDAFLADWNKLTQS

SEQ ID NO: 15097 - protein, 405 aa, Triticum aestivum
  unsure (1)..(405): unsure at all Xaa locations
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLRGPGAKKVLITXHPGKGDIPTYVCGVNADLYTHADTIISNASXTTNCLGPPCVKVLDQKFGIIKGTMTTTHSYTGDQRLLDASHRDLRXRARAAALNIVPTSTGAAKAVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSQRVVDLADIVADQWK

SEQ ID NO: 15098 - protein, 138 aa, Saccharomyces cerevisiae
HMSKVPRNFRLLEELEKGEKGFGPESCSYGLADSDDITMTKWNGTILGPPHSNHENRIYSLSIDCGPNYPDSPPKVTFISKINLPCVNPTTGEVQTDFHTLRDWKRAYTMETLLLDLRKEMATPANKKLRQPKEGETF

SEQ ID NO: 15099 - protein, 221 aa, Oryza sativa
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHFVDLVLIMSVNPGFGGQSFIESQVKKIAELRRLCAEKGVNPWIEVDGGVGPKNAYKVIEAGANAIVAAIKGIKTSQKPVAVPA

SEQ ID NO: 15100 - protein, 510 aa, Zea mays
MFLESFRVESPRVKYGDGEIQSEYRYDTTEVVPPGNGGGAGWVVRPKSVTYNFKTSTNVPKLGVMLVGWGGNNGTTLTAGVIANREGISWETKEKVHKANYFGSLTQASTIRVGSHNGEEVYAPFKSLVPMVDPNSIVFGGWDISKLNMADAMARAKVLDFHLQKQLRPYMESMLPLPGIFNPDFVAANQGARADNVIKGTKKEQVEQIKKDIKEFKEKNKVDKVVVLWTANTERYSNVVAGLNDTMDKLLASLDKNEAEISPSTLYAIACVLEGVPFVNGSPQNTFVPGLMELAIKKNSVIGGDDFKSGQTKMKSVLVDFLVGAGIKPTSIASYNHLGNNDGMNLSAPQVFRSKEISKSSVVDDMVASNPILYKPGEHPDHVIVIKYIPYVGDSKRAMDEYTSEIFMGGKNTIALHNTCEDSLLAAPIILDLVLLAELSTRIQLKAEGQDKFHSFHPVATILSYLSKAPLVPPGTPVVNALAKQRAMLENILRACIGLAPENNMMLEHK

SEQ ID NO: 15101 - protein, 472 aa, Chondracanthus spinosus
  unsure (1)..(472): unsure at all Xaa locations
ESGVIPYAKMGYWDPDYVVKETDVLALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAAAGETKGHYLNVTAATMEEIYERAEFAKELGSIIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESXXIARNEGRDYVAEGPQILQDAAKTCGPLQTALDLWKDIAFNYTSTDTADFVETPTANV

SEQ ID NO: 15102 - protein, 301 aa, Zea mays
FVSISQCTGLSLQHPWAFTFGLLGNVISFMTFLAPIPTFYRIYKSKSTEGFQSVPYVVALFSAMLWIFYALIKSNETFLITINAAGCVIETVYVVMYFVYATKKGRMFTAKIMLLLNVGAFGAILLLTLLLFKGDKRVVMLGWICVGFSVSVFVAPLSIMRRVIQTKSVEYMPFSLSLSLTLSAVVWFLYGLLIKDKYVALPNILGFTFGVVQMVLYVVYMNKTPLPVADGKAAGKLPSAADEHVVVNVTKLSPGRLPPVTQMAAVPTKSCATEAAAPATLPSRDVVDVLVNRHSPAVHVT

SEQ ID NO: 15103 - protein, 324 aa, Solanum tuberosum
MVFSSFPVYLDHPNLHQLQQPDGHQQGNTGLENPTLQPPPMQVGASPGSIRPGSMVDRARLAKIPLPEAGLKCPRCDSTNTKFCYFNNYNLSQPRHFCKTCRRYWTRGGALRSVPVGGGCRRNKRSKSNNNNNSSKTAGSNVNTNTIASGTSTSASPSSCSTEIMNGRHHFSHEQPPQLTPLMAAFQNLNHHYGGFQPPPLVSTHHGNGTGALGHHHEMGFQIGSSTNTNNLPVPPGGGSDHQWRLPSLAANTNLYPFQHGTDQGIHESSSVNNNNINAHDDQGLNSTKQFLGTMENNTNQYWGGNAWTGFSGLNSSSSASHLL

SEQ ID NO: 15104 - protein, 398 aa, Oryza sativa
MWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNHQNIDGGWGLHAEGESSMLSTALNYTALRLLGENVDDGPDISMHKARKWIHDHGGATMIPILGKVWLSVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQKALFMLCWWIENPNSDAFKRHLARVADFL

SEQ ID NO: 15105 - protein, 120 aa, Methanosarcina mazei Goe1
MIAMSNDDELEEIRKRRLAEIQRQQAQQPSDMQAAYQQEQARAEMEAQKQSILRQILTPEARERLTTLKMSRPALGEQLELQLISLAQSGRLQSQIDDEQLKTLLMRMQPKKRKTSITRV

SEQ ID NO: 15106 - protein, 125 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 15107 - protein, 514 aa, Arabidopsis thaliana
MAGGAFIDESGHGGDYEGRVTAFVMITCIVAAMGGLLFGYDIGISGGVISMEDFLTKFFPDVLRQMQNKRGRETEYCKYDNELLTLFTSSLYLAALFASFLASTITRLFGRKVSMVIGSLAFLSGALLNGLAINLEMLIIGRLFLGVGVGFANQSVPLYLSEMAPAKIRGALNIGFQLAITIGILAANIVNYVTPKLQNGIGWRLSLGLAGVPAVMMLVGCFFLPDTPNSILERGNKEKAKEMLQKIRGTMEVEHEFNELCNACEAAKKVKHPWTNIMQARYRPQLTFCTFIPFFQQLTGINVIMFYAPVLFKTIGFGNDASLISAVITGLVNVLSTIVSIYSVDKFGRRALFLQGGFQMIVTQIAVGSMIGWKFGFNGEGNLSGVDADIILALICLYVAGFAWSWGPLGWLVPSEICPLEIRSAGQSLNVSVNMFFTFFIGQFFLTMLCHMKFGLFYFFAGMVLIMTIFIYFLLPETKGVPIEEMGKVWKEHRYWGKYSNNDDGDDVDDDAYF

SEQ ID NO: 15108 - protein, 190 aa, Cucumis sativus
NSLVIGAYGIVCSVLNSETNEMVAVKKIANAFDNHMDAKRTFREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGNRIPAA

SEQ ID NO: 15109 - protein, 415 aa, Magnetospirillum magnetotacticum
MFILLGAVMVLAMHSGFAFLEVGTVRKKNQVNALVKIISDFAVSTIAYFFVGYGVAYGTNFLVGADVLIGKTGNAFAASGYDLVKFFFLATFAAAIPAIVSGGIAERAKFTTQLMATAILVGLVYPLFEGMVWGTRFGFQELMKGWFGAAFHDFAGSVVVHAVGGWIGLGAVLMLGTRLGRYRKDGRLVAFPPSNIPFLALGAWILSVGWFGFNVMSAQVIADISGLVAMNSLMAMVGGILTSLVVGRNDPGFIHNGALAGLVAVCAGSDVMHPIGALVTGGIAGALFVWLFNLCQIKWKIDDVLGVWALHGMCGFLGGVACGVFGQEALGGLGGVSFGGQIAGTVIGAAFGLAGGLAVYGGLKAAFGIRLSDEEEFAGADLSIHQIGAYPEDATTVHDDGLAMSVHSANKRKAG

SEQ ID NO: 15110 - protein, 176 aa, Triticum aestivum
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPRYYDGRYWTMWKLPMFGCTDATQVINEVEEVKKEYPDAYVRIIGFDNMRQVQCVSFIAFKPPGCEESGKA

SEQ ID NO: 15111 - protein, 410 aa, Pseudomonas aeruginosa PAO1
MSDYEPLRLHVPEPTGRPGCKTDFSYLHLSPAGEVRKPPVDVEPAETSDLAYSLVRVLDDDGHAVGPWNPQLSNEQLLRGMRAMLKTRLFDARMLTAQRQKKLSFYMQCLGEEAIATAHTLALRDGDMCFPTYRQQGILITREYPLVDMICQLLSNEADPLKGRQLPIMYSSKEAGFFSISGNLATQFIQAVGWGMASAIKGDTRIASAWIGDGATAESDFHTALTFAHVYRAPVILNVVNNQWAISTFQAIAGGEGTTFANRGVGCGIASLRVDGNDFLAVYAASEWAAERARRNLGPSLIEWVTYRAGPHSTSDDPSKYRPADDWTNFPLGDPIARLKRHMIGLGIWSEEQHEATHKALEAEVLAAQKQAESHGTLIDGRVPSAASMFEDVYAELPEHLRRQRQELGV

SEQ ID NO: 15112 - protein, 420 aa, Oryza sativa (japonica cultivar-group); identical to SEQ ID NO: 8467

SEQ ID NO: 15113 - protein, 149 aa, Zea mays
  unsure (1)..(149): unsure at all Xaa locations
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 15114 - protein, 179 aa, Pseudomonas aeruginosa PAO1
MSHKAETAFVPLNIAVLTVSDTRTLETDTSGQLFVDRLTEAGHNLAARVLLKDDLYRIRAQVATWIAEDSVQVVLITGGTGFTGRDSTPEAVACLLDKQVDGFGELFRQISLADIGTSTIQSRALAGLSNGTLVCCLPGSTNACRTAWEGILVEQLDARHRPCNFVPHLKQAAPCESRG

SEQ ID NO: 15115 - protein, 423 aa, Prunus persica
SAKGFFEVTHDISQLTCADFLRAPGVQTPVIVRFSTVIHERGSPETLRDPRGFAVKFYTREGNFDLVGNNFPVFFVRDAMKFPDAIRAFKPNPKSHIQETWRILDFFSHLPESLHTFAFFYDDLGVPQDYRHMEGSSVHAYTLISKAGKVHYVKFHWKPTCGVKCLLEDEAIKVGGANHSHATKDLYDSIAAGNYPEWKLYIQTMDPDHEDRFDFDPLDLTKTWPEDILPLQPVGRLVLNKNIDNFFAENEQLAFNPAHVVPGIYYSDDKMLQTRIFAYSDTQRHRLGPNYLQLPVNAPKCPHHNNHHEGFMNFMHRDEEVNYFPSRHDPVRHAERYPIPSNILSGKREKCVIEKENNFKQPGERYRSWAPDRQERFIHRWVDALSDPRVTHEIRSVWISYWSQADKSLGQKLASRLNVRPSI

SEQ ID NO: 15116 - protein, 245 aa, Pinus armandii
YTYSLRKKGPEDVIVKVIYCGICHSDLVQMRNEMGMSNYPMVPGHEVVGMVTELGSEVKKFKVGDHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKRCGILGLGGVGHMGVKIAKAFGLHVTVISSSDKKKEEAMEVLGADAYLVSKDAEKMMEAAESLDYIMDTIPVAHPLEPYLALLKTNG

SEQ ID NO: 15117 - protein, 338 aa, Zea mays
  unsure (1)..(338): unsure at all Xaa locations
MAKLGPGQGLGCEAAEGSLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKSFVGHGDSINVIRTQPLKPSLIISASKDESVRLWNVHTGICILIFAGAGGHRNEVLSVDFHPSDIERFASCGMDNTVKIWSMKEFWLYVDKSYSWTDLPSKFPTKYGQFPVLIAAVHSNYVDCTRWLGDFILSKSVVNEIVLWEPKTKEQSPGEGSIDILQKYPVPECDIWFIKFSCDFHFNQLAIXTILGAGEDGTIWRWDEVDHPSSRN

SEQ ID NO: 15118 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVSKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 15119 - protein, 132 aa, Zea mays
LGTPAVQGLLQAVQEGGAHNGNQCFLEAARYGSTELVRILLQVAQRNSLDIDVDLALGFAAHYGKIETMGCLVEEGNAIGFLGPLMRAAERGCLQVVECQIAVAAYLLPLVPQHVLAPLSIEIIKAAGERTT

SEQ ID NO: 15120 - protein, 150 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPN

SEQ ID NO: 15121 - protein, 730 aa, Geobacter metallireducens
MAKGILNKFAVIAGNKNAGLTAEEECTVVAPIKEVSGKAVHCRQAVKMAEEYLLALQNPEGYWVFELEADVTIPSEYIMLQRFLGREISPELRMRLENYLLDRQLPDGGWPLYAVDGFANISATVKAYLALKVLGHSPQAPHMIRARIMVLSLGGAARCNVFTRILLALFGQLPWHTPPAMPVEIVLLPQRFFFHLSKVSYWSRTVIVPMLLLYAKQPVCRLRPEEGIPELFNTPPDKLRNLDGFQSGRWRKNAFIIIDRLLKRFNRFIPSAIHRKAMAEAEHWTRSRMQGSGGIGAIFPAMAYAVMALRVLGCREDDPDYVRGMQAIDDLLQHRTPQEADSPRTGGPCIDSGTSAAFAFDPSPHAAADGRGNSSICQPCNSPIWDTCLSLSALMEAGMPASHPAAKQAVEWLLSQQIFSPGDWSLKAPDLEGGGWAFQFENTLYPDLDDTSKVIMSLLRAGALENGLYRDRVARGVNWVLGMQSSDGGWAAFDIDNNYHYLNDIPFADHGALLDPSTSDLTGRCIELLSMVGFDRTFPPIAQGIGFLRSKQEGSGAWFGRWGVNYIYGTWSVLSGLRQAGEDMQQPYIRRAVGWLTSCQNHDGGWGETCYSYDDPSLAGQGESTPSQTAWSLLGLMAAGDVHSLAVRRGVRYLLDHQNQWGTWEEKHFTGTGFPRVFYLRYHGYRHYFPLWALGVYSRLSSGQKTRQEERRHSSPGDLHLPWLERIGRR

SEQ ID NO: 15122 - protein, 481 aa, Pseudomonas syringae pv. syringae B728a
MEKVFMYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 15123 - protein, 468 aa, Gelidium latifolium
  unsure (1)..(468): unsure at all Xaa locations
IPYAKMGYWDPDYAVKETDVLALFRVSPQPGVDPVEASXAVAGESSTATWTVVWTDLLTACDLYRAKAYKVEAVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 15124 - protein, 963 aa, Vicia faba
MEPFTRDHRGSLEVFNPSSSETNGTPNPNPNPNPSNSWNTGTSSRGTEAPPLRDSIISDEVPTATSWMALKETTPSPKSGESGSVAEQRAAEWGLVLKTDSETGKPQGVGVRGSGGGGGSRRDSNNSVRSSGESSDDGREGGRGIPRVSEDLRDALSAFQQTFVVSDATKPDYPIMYASAGFFSMTGYTSKEVIGRNCRFMQGADTDPNDVAKIREALAAGTSYCGRLLNYKKDGTTFWNLLTIAPIKDEHGKILKLIGMQVEVSKHTEGTKEKMLRPNGLPESLIRYDARQKEKANSSVTELVEAVSKRPRSLSESANRLPFNKKPTNGSNDHATPPNSESSSRKSGSTLRSFRRKSHSGAGNSNSMHPITELPENNNKSRRRSFMGFMRKSLSNNERFNHEQVIDRNSSEDEDRLDSFDEQNIAQKREKRKGFDLATTLERIEKNFVITDPRLPDNPIIFASDSFLELTEYSREEILGRNCRFLQGPETDPATVKKIRYAIDNQTEVTVQLINYTKTGKKFWNLFHLQPMRDQKGEVQYFIGVQLDGSQHVEPLHNGIAEDTAKEGENLVKKTAENVDDALRELPDANMKPEDLWMNHSKVVHPKPHRREDSAWRAIQKIMESGEQIGLKHFKPIKPLGSGDTGSVHLVELCGTDHHFAMKAMDKGVMPNRNKVHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPELIVPSTNDKKKGQHGPIFMAEPMRASNSFVGTEEYIAPEIITGSGHTCAVDWWALGILLYEMFYGYTPFRGKNRQRTFANILHKDLKLPKSKQVSLSAKQLIYHLLQRDPTSRLGSKGGANDIKHHSFFKGINWALVRCTKPPELDAPLFDTNKEEKEKDDKYVDNGQEDMSVF

SEQ ID NO: 15125 - protein, 507 aa, Yersinia pestis
SGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 15126 - protein, 66 aa, Brassica napus
VSKYPDLKGINFDLPHVIEEATSHPGIDHVGGDMFVSVPKGDAIFMKWICHDWSDEHCVKFLKNCY

SEQ ID NO: 15127 - protein, 170 aa, Helicobacter pylori
GSGMHTHVSIWKNNENLFGGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESH

SEQ ID NO: 15128 - protein, 323 aa, GIBBERELLA ZEAE PH-1
MDGKRHPSSFQQLEKLGEGTYATVFKGRNRQTGELVALKEIHLDSEEGTPSTAIREISLMKELKHENIVGLHDVIHTENKLMLVFEYMDGDLKRYMDTNGERGALKPTTIKSFMYQLLKGIDFCHQNRVLHRDLKPQNLLINNKGILKLGDFGLARAFGIPVNTFSNEVVTLWYRAPDVLLGSRTYNTSIDIWSAGCIMAEMFTGRPLFPGTTNEDQIVRIFRIMGTPTERTWPGITQFPEYKPTFHMYATQDLRNILQTIDPTGIDLLQRMLQLRPELRISAHDALQHAWFNDLLVHPQQQNLQSQARAYPQAVPSQAFDTY

SEQ ID NO: 15129 - protein, 100 aa, Zea mays
  unsure (1)..(100): unsure at all Xaa locations
ITMDPTKFRPSSSHDTTVTTTNAGAPVWNDNEALTVXXXAAILLEDYHLIEKXADFAREXLPERVVSPPRAPRKGFLRWPPDGTPLKXAQFRRGPGGETP

SEQ ID NO: 15130 - protein, 624 aa, Oryza sativa
  unsure (1)..(624): unsure at all Xaa locations
MELSWSLAAVLHSPLFLLAALLLLPVFTLLSFSSAKKPGDGGGWRLPLPPSPRGVPFLGHLPLLGSLPHRKLRSMAEAHGPVMLLWFGRVPTVVXASSAASAQEAMRARDAAFASRARVRMAERLIYGRDMVFAPYGEFWRQARRVSVLHLLSPRRIASFRGVREQEVAALLDRVRRRCGVRGGGETVNLSDLLMSYANGVISRAAFGDGAYGLDGDEGGEKLRELFANFEALLGTATVGEFVPWLAWVDKLMGLDAKAARISAELDGLLERVIADHRERRRLSQPDGGDGDGDGDENVDHRDFVDVLLDVSEVEEGAGAGEVLLFDTVAIKAIILDMIAAATDTTFTTLEWAMAELINHPPVMRKLQCEIRAAVGVPGASGGAEVTEDHLGELRLLRAVVKETLRLHAPVPLLVPRETVEDTELLGYRVPARTRVIINVWAIGRDAAAWGDRAEEFVPERWLDGGGEEVEYAAQLGQDFRFVPFGAGRRGCPGAGFAAPSIELALTNLLYHFDWELPPHADGAAAATAARLDMGELREIKKNIEVGSPPDDNDLIQEILLCLPSHSSSISRAFLVYKRWRRLVSDYVLVPLDHTSPLRLNGDRRDRVTSLLSYCRRGYSRTVF

SEQ ID NO: 15131 - protein, 304 aa, Bacillus anthracis str. Ames
MNYKKWDLRIICAHAFTILIWGSAFPAIRMGLESYTPEHLTLLRLLIASVILLLFSFIYKLRLPDLKDIPAIFIFGALGFTFYHIALNYGEKTVNAGSASLIVSVTPIVTAIFASVFMNEKMKLNGWIGGVISFIGIAFISFSQGDAIQLNSGALFILLAAISESLFFVFQSSYLKKYGFLPFTIYTILSSTVCMLIFLPGMYQEILAAPLEVNLSVIYLGVFPTVLPYIALAYIISRAGASEATSSLYLTPITACFVAWIWLGEVPTLVSIIGGGITILGIVIVHIPVLRKEKHSNLANNQSV

SEQ ID NO: 15132 - protein, 402 aa, Oryza sativa (japonica cultivar-group)
MASPMLSAATVPLQGGGLSEFSGLRSSSSLPLRRNATSDDFMNAVSFRTHAVGTSGGARRAPTEAKLKVAINGFGRIGRNFLRCWHGRGDSSPLDVIAINDTGGVKQASHLLKYDSTLGIFDADVKPVGDNAISVDGKVIKVVSDRNPSNLPWGELGIDLVIEGTGVFVDRDGAGKHIQAGAKKVLITAPGKGDIPTYVVGVNADQYSPDEPIISNASCTTNCLAPFVKILDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 15133 - protein, 364 aa, Saccharomyces cerevisiae
MISIVLELFQNLCCCRGFSDATIRVNDKRYRIQRLLGEGGMSFVYLVQLSKNSLIIDNGIATPELYALKKIICPSVESISNGMREIENYKRFQSPYVIKSIDSQVMQEKDGSKTIYIVLPYYSLGSLQDSINRRLLEGTFVSEAECVRIMLGVTRGLLCLHDPASRQDNATSRVNVDAVSMTYSDETAMLLEDTPLEMDMLSSNSAGSIAYAHRDITPSNILFSSDGLPVIGDLGSCSQADITIENRHQLSELQEWVNDNCTLPYTPPELLNLKLNQVLSSKVDIWSLGCTFYTLMFGISPFEREEQIHGASLTYAINTGKYSFPRNSRFSEGLLSVIKKCIQVDPIQRPTTSQLLNLLQDLDT

SEQ ID NO: 15134 - protein, 329 aa, Triticum aestivum
  unsure (1)..(329): unsure at all Xaa locations
MGVKGFVEGGIASIVAXGCSTHXPLDLSQGPGMQLQGESSAAAAQXRSRPALAFPGPGRHTADAPRTRPXRRALPRPIVICTQILRADGRLRALLGXSSATMLRQTLYSTTRXMGLYDILKISGPPTEPPAAACCRCTSPPAFAGGVGEPPAVPADLATGVLRIDGRLTARRPRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDAEF

SEQ ID NO: 15135 - protein, 454 aa, Hypnea sp. IzuH1
GYWDPDYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLRKDITFNYTSTDTADF

SEQ ID NO: 15136 - protein, 218 aa, Triticum aestivum
MKTFFLVTLLLAAAVCTHGREQVKDSNGNPVKRGAKYFIQPAKSNAGGLVPAAINLLPFCPLGITQTLLPYQPGLPVSFGYEPVIVGTDYIYTSTTINIEFESDIWPVCNELSKLWAVDVSSSAAKEPAIIIGGESTAPNSLFKIEEATEANSYKLTTSYGTVGTIPGPWLSAPQLIVTNDESKTLFVKFVKVDDAATKATTSTSRVEKLGLKMFPFC

SEQ ID NO: 15137 - protein, 740 aa, Pleurotus ostreatus
MSSVTAAAKQAVSSITDNAKMASLTQFRVECGPSQRMTTDQGLHVADTDNCNSNVGPALLEDHIAREKIMRFDHERIPERVVHARGAGAHGYFKAYDSSAEQWTKAKVLMDPSRTTPVFVRFSTVQGSRGSADTVRDVRGFAVKFYTEEGNWDIVGNNIPVFFIQDAIKFPDIIHAVKPEPHNEVPTGQSAHNNFWDFVGLQPESAHMIMWVMSDRAIPRSYRMMQGFGVNTYTLLNATGEKHFVKFHWIPELGVHSLVWDEALKIAGQDPDFHRKDLNEAIESGAYPKWRLALQVISEKDEHNFDFDILDATKIWPEELVPLHFVGEMVLNKVVDEYFAEVEQVAFCTSNIVPGIGFSDDPLLQGRNFSYLDTQLSRLGINWQQIPINRPVCPVMNFQRDGQMQMKIHKGTVNYWPNRQEAVQPVAVSEGGYDDHVRKISGIAQRMRGPKFNEHYSQAQLFYNSLSPTEQTHLQSALAFELSHCEDPAVYRNYINILNNIDYQLAKYVAVAVGGDVPDASAKPNEGNKSARLSQVYYAPKEPTIKGRRIAILLADGFDKAEVVAIKALITSASANAFVIGPRRGKVYAAGEKIGVEGGGIDADHHFEGQRSTMFDALVIPSGEHVALLMKSGRAVHWLREAFGHCKAIGAVGEAILFVQQAINLPEVQYADPTDSSMEVVASYSVVTTAHYGVSTAIGDATKMTLNIGEKGFMERFAYEVSKHRCFKREEDGLTARIAY

SEQ ID NO: 15138 - protein, 221 aa, Escherichia coli
DLLDADYMAYMLKYDFTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 15139 - protein, 342 aa, Triticum aestivum
  unsure (1)..(342): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVXDVSVVDLTVXRTEKAASYDDIXKKAIKAASEGKLKGDHGLXVEEDLVSTDFXGDSKSEASLMPRAGIALNDHFVKLVSWYDNEWGYSNRVVDLIRHMAKTQ

SEQ ID NO: 15140 - protein, 99 aa, Tulipa gesneriana
MAKNHKLPAAALKQMLMRCSSIGRRQNCQGLPVDVPKGHFVVYVGEKRSRFIVPISYLARPEFQQLLRHAEEEFGFEHDIGLTIPCEEVVFRLLTLALR

SEQ ID NO: 15141 - protein, 477 aa, Streptomyces peucetius
MCPPSSPTTYPSSPCDPPPLRKGLVRMTTTLVPPGPRGHPVLGSIREIQRDNVSAFMEAFRHHGDIVNFRGPLRINLLAHPDYVQHVLRDQHKRYPRPRKVQGCLSTIVGDGLVAAEGTSWLRSRRLTQPAFHRDILRRFGDSFTASTAELLDGWERRARDGEPLDIKSEMMHLSLANLARALFRTEWTDEVSRIEPAVQEALGFTHRRMTSPVDPLKFPSAARTRFRGALETINSLLYPMVAERRRDGGGDDLVSLLIDAVDPESGGMFTDEQIRDEVSGFFVAGHETVSTALSWTWYLLSLNPESRRRLQAEVDEVLAGRVPTVDDLPKLTYTTMVLQESMRLYPPIFVYMRCAAEDDVIGGYHIPEGRWVVVCPYVTHRHPEFWDNPEGFEPERFTPENSANRHRMAYLPFGAGPRKCIGDSFAMLQMPLVVAMIAQRFRLDLVEGQQVFPEPAISLRPRDPLMMWLRPNEETP

SEQ ID NO: 15142 - protein, 364 aa, Populus tremuloides
MGSTGETQMSPAQILDEEANFALQLISSSVLPMVLKTAIELDLLEIMAKAGPGALLPPSDIASHLPTKNPNAPVMLDRILRLLASYSILICSLRDLPDGKVERLYGLASVCKFLTRNEDGVSVSPLCLMNQDKVLMESWYHLKDAILEGGIPFNKAYGMTAFEYHGTDPRFNKVFNKGMSVHSKMAMKKILETYKGFEGLASLVDVGGGTGAVVSTIVSKYPSIKGINFDLPHVIADAPAFPGVENVGGDMFVSVPKADAVFMKWICHDWSDEHCLTFLKNCYDALPENGKVILVECILPVAPDTSLATKGVMHVDVIMLAHNPGGKERTDREFESLARGAGFKGFEVMCCAFNTHVIEFRKKA

SEQ ID NO: 15143 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQSPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 15144 - protein, 90 aa, Glycine max
  unsure (1)..(90): unsure at all Xaa locations
MNHKDAGMCDNLKLDVAALILGYHDDCSYADQHRSHICVHDINRARFLCKPKPRXVTQSQPVVTAVWNSAQKLXSRNYAGVHEAIRAFNW

SEQ ID NO: 15145 - protein, 506 aa, Methanosarcina acetivorans C2A
MKTSNVELNPNKLVQYLNKPASEFTKDDIIRFIKENGIKMLNFRYVGGDGRLKALTFVIRDEEHLDNLLSAGERVDGSSLFSYIEADTSDLYVLPKYRTAFVNPFEEIPTVDILCSYFDKDGTPLISASETIMKKASQVLTEKTGYELQAMGELEYYIIANSGEVNMGFPAVDQRGYHESNPFTKYDQLRKEAMMYIAEAGGKIKYGHSEVGNFTDNNYYYEQNEIEFETDTLENSADRLLIAKWMLRMLADQYGVVISFAPKITVGKAGSGLHVHMKLLKDGKSIMVENGDISDAAKRAMAGLLDVAAGITAFGNRVPTSYLRLVPHQEAPTNICWGDRNRSALIRVPLGWFSDDCSKMIAHVNPNYCEDFKSHSYKSTFEFRAADPSADLYLLFAAFAVGIRHGFEMDNALEIAKNLYIDVNIFKDEHKDRLAQLEHLPASCYESAQALKKYKDIFTQYDVFTEGMIDDTVKYLESLDDYQLSERLYGKNEEIKKLVDSYIHIA

SEQ ID NO: 15146 - protein, 358 aa, Cytophaga hutchinsonii
MSASKAVNFPIERTQHSRLSETDFSNLEFGTVNSDHMFVVDYKKGEWVDPKIIPFQNISVSPACSSLHYGQTVFEGMKAFRAPNGDLLVFRPEKHLERMNNSNRRLCIPEIPAEYFYDAIDALVKLDQDWIPNQEGCSLYLRPFIFANDPFIGVKPSSAYKFMIFTCPVAGYYKGTVKVIIESDFVRASPGGIGAAKTGGNYAASLLPAKLAADKGYQQILWTDSKEHKYFEESGTMNLMFVINDVLITPSLDGSILPGITRDTILTIAKDWGVKVEERRVSVEEVITAFNNGTLQDAFGTGTAATITQIAEIHHNGKDMVLPPVAGRTLSNKLNQTIVDLKNGIGEDKYNWVHRIKK

SEQ ID NO: 15147 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRAMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 15148 - protein, 534 aa, Methanosarcina barkeri
EIPTYAGGLGILAGDTIRSAADLNIPLVAVTLVSNKGYFRQILDSSGNQIEHTEEWNPARFMTLLAEDVHVKIQNRDVKIRAWLHNYKSLTGGCVPIIFLDTDVEGNDREDRRITDFLYGGDQRYRLKQEIVLGIGGVRMLDALGFRIRKYHMNEGHSSLLGLELLRCNGIDPVKVKELCIFTTHTPVEAGHDKFDYGLVEDLIQDKKCVDVLRRFGGVDRFNTSLFALNLSNYVNGVTKRHSLISSELFPGYKIQAITNGVHSYTWTSPYFRKLYDRYLPGWANEPELLVRIDGIPDTEIWEAHWNAKKALIDEVNKRTGVGMDYETLTIGFARRMTAYKRATMALSDPEMLKKINRRGKIQLIFAGKAHPNDGAGKQLIRDIFKSIEILREEIKIVFLENYDMDLAGKMVSGVDIWLNTPTRPYEASGTSGMKAAHNGVVNLSVLDGWWIEGWIEGVTGWAIGPQPEEKLSDEGAKAAELSDLYNKLYYIIVPMYYDRKDEWVKLINNSIGMIAYYFNSHRMMRRYVTHAYL

SEQ ID NO: 15149 - protein, 479 aa, Gracilariopsis longissima
QIKNERYESGVIPYAKMGYWDPDYVIKDTDVLALFRVTPQPGVDPVEASAAVAGESSTATWTVVWTDLLTACDLYRAKAYKVEAVPNTTDQYFAFISYDLDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRAVAATGEIKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNERRDYVAEGPEILRVAAKTCGPLQTALDLWKDITFNYTSTDTADFVETPTANV

SEQ ID NO: 15150 - protein, 181 aa, Zea mays
  unsure (1)..(181): unsure at all Xaa locations
RLQVPVRNSRVDPRVRREFQDSSRCSTPSLDPERHERLREKMRRRMDSGDKWFSLEFFPPXRFDRMAAGGPLFVDVTWHPAGDPGSDKETSSMMIASTAVNYCGLETILHMTCCQQRPEEITGHLHRAKQLGLKNIMALRGRYPVGDHXEAEEGGFSYATDLVKHIRTEFADYFDICVAGK

SEQ ID NO: 15151 - protein, 342 aa, Arabidopsis thaliana
MMLLVHTRRKLESLSGFNSITSFGDLGESVCGPAGRLVVDVMLVLSQSGFCVSYLIFVATTMANLLSRGTEHILGLDAASIYLWGCFPFQLGLNSIPSLTHLAPLSIFADIVDVAATLVVMVQDVFIFLKRRPPLRVFGGVSVFFYGLGVAVYAFEGIGMVLPLELEAKYKDKFGRALGLAMGLISIMYGAFGLLGYMAYGEETKDIITTNLGTGVVSTLVQLGLAINLFFTFPLMMQPVYEVVERRLCSSRYSVWVRWATVLVVTLVALLVPNFADFLSLVGSSVCVVLGFVLPSLFHLQAFKNELSITRIVVDVLVFLIGVMIAITGTWTAVHEILTSKA

SEQ ID NO: 15152 - protein, 486 aa, manganese-oxidizing bacterium SI85-9A1
MDQGSQTIKGKDRYKSGVMEYRKMGYWEPDYEPKETDVIACFRITPQDGVDPIEAAAAVAGESSTATWTVVWTDRLTAAEKYRAKAYRVDQVPNTDDQYFAYIAYDLDLFENGSIANLTASIIGNVFGFKPLKGLRLEDMRLPTAYVKTFQGPATGIVVERERLDKFGRPLLGATVKPKLGLSGRNYGRVVYEALKGGLDFTKDDENINSQPFMDWRERFLYCMEAVNKAQAATGEIKGTYLNVTAATMEDMYERAEFARDLGSNIIMIDLVIGWTAMQSMAKWARRNNMILHLHRAGHSTYTRQKTHGVSFRVIAKWARLAGVDHIHAGTVVGKLEGDPATTKGYYDICRDEFTHRKLENGIFFDQPWASLNKMMPVASGGIHAGQMHQLLDLLGDDTVLQFGGGTIGHPMGIAAGATANRVALECMVLARNEGRDIVNEGPEILQEAARSCTPLQQALETWKDVTFNYTSTDSPDYAVTATASV

SEQ ID NO: 15153 - protein, 317 aa, Agrobacterium tumefaciens str. C58
MSGQGTAPLVAVIATGGTIASRRGADGASTPSLSGEDLLALVPQVNARLKPVDLMAKDSSSLTLANMQRISDAVGIELSDPAVAGIVVLHGTDAMEESSLLVHLQHALPKPVVFTGAQFTADHRQADGPANLARAIETALDQRNAEKGVLLSFGGRCLPAWGLYKLSADAADAFRSARPQVQAAAPKLAAPVTDIRVDIVAIHPGCDATHIDASLAAGAKGIVLAALGSGNANPLIAEAVKRCAERRVPVVVSSRVPEGLLVASYGGGGGGHDLVAVGAVHSSTLRPGQARILLAALLASNSSAETIVSAFGEPLSH

SEQ ID NO: 15154 - protein, 337 aa, Rhodospirillum rubrum
MATWKLAPALAAGNCIVLKPAEQTPISILVLTELIADLLPPGVLNVVNGFGLEAGKPLASSKRIAKIAFTGETATGRLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 15155 - protein, 157 aa, Zea mays
  unsure (1)..(157): unsure at all Xaa locations
RDVALFGADLPPCATCQGTRGSRXSAGGLEEEIRMFQTRVLLGGMNMYDRYQDWRLDVDNMTYEELLELGDKIGYVNTGLRDDEITRNLRKVKHPSFSSLRFATEMERKCSICQEEFETNEEMGRLDCGHSYHVYCIKQWLSQKNICPVCKTAVSKN

SEQ ID NO: 15156 - protein, 227 aa, Saccharomyces castellii
HVIRYFPTQALNFAFKDKIKAMFGFNKERDGYTKWFMGNVASGGCAGALSLLFVYSLDYARTRLAADAKSIKSGAPRKFNGILDVYKKTLFTDGVLGLYRGFLPSVVGIMVYRGLYFGLYDSLKPVLLTGSFENAFLPSFLLGWAVTISASTTSYPLDTVRRRMMMTSGQAVKYKGAIDCFQQIVSQEGVYSLFKGCGANIFRGVAAAGVISLYDQLQLLLFGRKFK

SEQ ID NO: 15157 - protein, 181 aa, Hordeum vulgare subsp. vulgare
MASDGRVERIASSIRAIPNFPKPGILFQDITTLLLDPQAFRDTTDLFVERYKDKSITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDLPVFVLVQADESV

SEQ ID NO: 15158 - protein, 339 aa, Oryza sativa
  unsure (1)..(339): unsure at all Xaa locations
GDAGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIXXXXXXXXXXXXXXXXXXXXXXXWGYSNRVIDLIRHMAKTQ

SEQ ID NO: 15159 - protein, 99 aa, Zea mays; identical to SEQ ID NO: 3237

SEQ ID NO: 15160 - protein, 456 aa, Gelidium floridanum
  unsure (1)..(456): unsure at all Xaa locations
YAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGXXXXXXXXXXEDMYERAEFAKQLGAVIIMIXLVIGYTAIQTMAIWARKNDMISHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGDDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 15161 - protein, 475 aa, Bacillus anthracis str. A2012
MQQTTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVEMEKANETNNQTR

SEQ ID NO: 15162 - protein, 290 aa, Juglans nigra x Juglans regia
MDQYEKVEKIGEGTYGVVYKARNRKTNQTLALKKIRLEQEDEGVPSTAIREISLLKEMQHGNIVKLQDVVHGEKRLYLVFEYLDLDLKKHMDSSPEFANDLRQIKMFLHQILRGIAYCHSHRVLHRDLKPQNLLIDRRSNSLKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDYKGAFPKWPPKDLAAVVSSLDSTGVDLLSKMLSLDPSRRITARTALEHEYFKDI

SEQ ID NO: 15163 - protein, 202 aa, Phytolacca americana
KRRNGLLKKAYELSILCEAEVALIVFSSRGRVYEYSNNNIRSTIERYKKASSDGSNSASFIEINAQYYQQESAKLRQQIQVMQNSNRNLVGECLSSLNVKELKQLENRLERGMSRIRSKKHELLLADIEFLQKREKELEHENSFIRAKINEVERLQQLNMMPSEDLSAMNAFVTRSDHILAQNMLDTSSAFSNASKKLLHLG

SEQ ID NO: 15164 - protein, 245 aa, Hordeum vulgare subsp. spontaneum
GFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVIISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKA

SEQ ID NO: 15165 - protein, 838 aa, Solanum tuberosum
MEGGAKSNDVSAAPIAQPLSEDPTDIASNIKYHAQYTPHFSPFKFEPLQAYYAATADSVRDRLIKQWNDTYLHYDKVNPKQTYYLSMEYLQGRALTNAVGNLDIHNAYADALNKLGQQLEEVVEQEKDAALGNGGLGRLASCFLDSMATLNLPAWGYGLRYRYGLFKQLITKAGQEEVPEDWLEKFSPWEIVRHDVVFPIRFFGHVEVLPSGSRKWVGGEVLQALAYDVPIPGYRTKNTNSLRLWEAKASSEDFNLFLFNDGQYDAAAQLHSRAQQICAVLYPGDATENGKLLRLKQQFFLCSASLQDIIARFKEREDGKGSHQWSEFPKKVAIQLNDTHPTLTIPELMRLLMDDEGLGWDESWNITTRTIAYTNHTVLPEALEKWSQAVMWKLLPRHMEIIEEIDKRFVATIMSERPDLENKMPSMRILDHNATKPVVHMANLCVVSSHTVNGVAQLHSDILKAELFADYVSVWPTKFQNKTNGITPRRWIRFCSPELSHIITKWLKTDQWVTNLELLANLREFADNSELHAEWESAKMANKQRLAQYILHVTGVSIDPNSLFDIQVKRIHEYKRQLLNILGVIYRYKKLKGMSPEERKNTTPRTVMIGGKAFATYTNAKRIVKLVTDVGDVVNSDPDVNDYLKVVFVPNYNVSVAEMLIPGSELSQHISTAGMEASGTSNMKFALNGCLIIGTLDGANVEIREEIGEDNFFLFGATADEVPQLRKDRENGLFKPDPRFEEAKQFIRSGAFGTYDYNPLLESLEGNSGYGRGDYFLVGHDFPSYMDAQARVDEAYKDRKRWIKMSILSTSGSGKFSSDRTISQYAKEIWNIAECRVP

SEQ ID NO: 15166 - protein, 405 aa, Photobacterium profundum
MGGVLGMILAGGEGSRLRPLTDSRTKPAVPFGGSYRLIDFALNNFVNADFLKIYVLTQFKSQSLYVHMKKGWNITGITDRFIDPIPAQMRMGKRWYDGTADAIYQNLSFIELAEPEHVCIFGSDHIYKMDIKQMLNFHKEKEAELTVSALRMPLSEASAFGVIEVDENGCMVGFEEKPTNPKSIPGDPENALVSMGNYIFNKDTLCTELEEDAAKEDSSHDFGKDIIPKLFPLGKVYVYDFTTNIIPGEKNTGYWRDVGTIEAYWQAHMDLLSEDAPFSLYNRQWQLHTHYPPLPPATILDSENSKVDINNCMISAGSYIRGAQIHKSILGFRTNVDHNTMISESVILGDVKIGANCSIRKAIIDKNVHIAPGTVIGENPEEDKKNYHVSDEGIVVIPKGAKIGY

SEQ ID NO: 15167 - protein, 594 aa, Zea mays
  unsure (1)..(594): unsure at all Xaa locations
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESEPVYISISCNLPSIPHPTFSRHPVPFFLSPRLSNQMNLEAAVEAAAAFLNKAVKPVLVGGPKMRVSKACEALAELADACGYPVAVMPSAKGLVPEHHSRFIGTYWGAVSTPFCAEIVESADAYLFAGPVFNDYSSVGYSLLLKKEKAIIVQPERVVVGHGPAFGXCVLMKDFLHALATRLKKNTAAYENYRRIYVPLGEPLPSEPGEPLRVNVLFKHIQAMLSGDTAVIAETGDSWFNCQKLKLPEGCGYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 15168 - protein, 385 aa, Solanum tuberosum
MGSLCSSRNKHYSQADDEENTQTAEIERRIEQETKADKHIQKLLLLGAGDSGKSTIFKQIKLLFQTGFDEAELKNYIPVIHANAYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSCMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 15169 - protein, 129 aa, Glycine max
  unsure (1)..(129): unsure at all Xaa locations
MALNNGVPATGSGLIVSFGEMLIDFDPTVSGVFLAXEASGSLKDPGGAPVNVGIVVSRLGGKAAFCGXLVYNKLGHMLAGILKENGVRADGIHSDQGARTVLVFVTLLAGGERVFMFYRNHSVYMLLKP

SEQ ID NO: 15170 - protein, 394 aa, Leuconostoc mesenteroides subsp. mesenteroides ATCC 8293
MHFEESDLLKTLPKQFFATLVAKVNAKIAAGKDVINLGQGNPDQPTPEYIVESLQAAAENPADHKYSLFRGEERFKKAIAEFYADEYGVSIDPETEVAILAGSKIGLVELPWALMNPGETLLLPDPGYPDYLSAAALGRVNYEAVPLKQENNFLVDYEAIPNSVAEAAKFLYLNYPNNPTGAIATSEFYQQTVRFAEENQVGIVSDFAYGAIGYDGHKPLSFLQTENSKSVGIETYTFSKTFNMAGWRVGFAVGNAEMIEALNLIQDHLFVSLFPAVQDAAIEALTNRAAREKAVTDLTNLYQRRRDVFINAVREFGWEPYVPRGAFYVLMPVPKGYTSSEFADLLLEEANVAVADASGFGKGGQGYIRVGLTIVEERLAEAAKRISKLPIFSK

SEQ ID NO: 15171 - protein, 386 aa, Catharanthus roseus
FLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 15172 - protein, 310 aa, Staphylococcus delphini
GFGRIGRLAFRRIQDVENIDVVAVNDLTDDDMLAHLLKYDSTQGRFTEEVEVIDGGFRVNGKEVKSFSEPEPKNLPWGELDIDVVLECTGFFTDKEKAEAHIEAGAKKVLISAPAKGDLKTVVYNVNHEILDGTETVVSGASCTTNSLAPVAKTLQDNFGIVEGLMTTIHAYTGDQNTLDAPHRKGDKRRARAAAENIIPNSTGAAKAIGLVIPEIDGKLDGGAQRVPVATGSLTELTVVLEKEVSVEEVNKVMKEATNESFGYTEDEIVSSDVVGMTFGALFDATQTRVMTVGDRQLVKVAAWYDNEMS

SEQ ID NO: 15173 - protein, 446 aa, Tropheryma whipplei str. Twist
MYSCTGFSRRVCTWWKSVMCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 15174 - protein, 249 aa, Xylella fastidiosa 9a5c
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 15175 - protein, 615 aa, Odontella sinensis
MISGTARALASSASNASKRAFHASARSDARKFFVGGNWKCNGSVQQVNDLVSMLNQSTLSTDTEVVVCPSQVYVQGVSEKLRKDIGVGAQDCWVQGNGAFTGETSADMLADMGVGWVVIGHSERRGKGEADEEVARKAKYALDKGLKVIACCGEPLESREAGTTNDFVFPQIKAYADVFSKEDWANVVIAYEPIWAIGTGLTATPEQAQDTHADIRQYLGEVAGADVAESTRILYGGSATGATAPGLSAKPDIDGFLVGGASLKPEFADIVNCQGGETSLKPVNIGINGFGRIGRLVMRAAQNDPMVNIVSVNDPFIPVNYMEYMLQYDTVHGEYPGTVKQTGDDTLSIDGKDVKVFGEMDPSKIQWGSVGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDKDIVSSDFISDRHSSIFDEKAGIALTDDFVKLVSWYDNECGYSNRVLDLIKHMDVSK

SEQ ID NO: 15176 - protein, 278 aa, Oryza sativa
  unsure (1)..(278): unsure at all Xaa locations
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKITTKAVLEVKPFCLHSSEQLMETEKEKNNAIINTNREEQNGATPSTSSPTPVTAPDPIPTTNNSYAVFPHLNSXQSQPRGSGESEAQPSPAQAGNSKLPPWMLRTSHT

SEQ ID NO: 15177 - protein, 115 aa, Glycine max
  unsure (1)..(115): unsure at all Xaa locations
MKPMKKQAGAGMDAPFTGLKSMAGFPTRKTINDFSFIAXFGGRVLCMQVWPPVDKKKFVTLSYLPDLDDAQLAKEAEYLLRKGWIPCLEFQLEHGFLYREHIGSPXYYYGRYWSL

SEQ ID NO: 15178 - protein, 356 aa, Nostoc punctiforme
MRQPAHGGNLAWAAALAGCPPDAILDFSASISPLGPPNSAIAAILSQLGNLKHYPDPNYSELRLALSHFHQLPPEWILPGNGSAELLTLIGRELAQLAATTLITPAFGDYYRTLAAYNANVLECPLSLVTGHWSLFLDKGQKTKDKGLLLNNPHNPTGKIFSRDSILPYLEQFALVVVDEAFMDFVPPNEEQSLIPVVQEYTNLVILRSLTKFYSLPGLRLGYAIAHPDCLAKWQLWRDPWPVNTLAAAAAIAALQDAEFQQQTWAWLPPARNQLFQSLAEIPGLQPQVSAANFLLVESQESTSQLQHQLLKYHQILIRDCLSFKELGDRFFRVAVREESDNQRLLTALNSVLSGK

SEQ ID NO: 15179 - protein, 853 aa, Bacteroides thetaiotaomicron VPI-5482
MIMMKRYKKILLTGVLSALSCSFVHAQELYKNENAPVHERVMDLISRLTVEEKISLLRATSPGIPRLGIDKYYHGNEALHGVVRPGRFTVFPQAIGLAATWNPELQKRVATVISDEARARWNELDQGREQKEQFSDVLTFWSPTVNMARDPRWGRTPETYGEDPFLSGIMGTAFVNGLQGDDPHYLKIVSTPKHFAANNEEHNRFVCNPQISEKQLREYYFPAFEMCVKEGKAASIMSAYNALNDVPCTLNPWLLQKVLRQDWGFQGYVVSDCGGPALLVNAHKYVKTKEAAATLSIKAGLDLECGDDVYDGPLLNAYKQYMVSDADIDSAAYHVLTARMKLGLFDSGERNPYTKISPSVIGSKEHQQIALDAARQCVVLLKNQKNRLPLNADKLKSIAVVGINAGKCEFGDYSGAPVVEPVSILQGIRNRVGDRVKVVYAPWKSAADGLELIQGENFPEGLQAEYFDNTRLEGTPRVRKESWINFEPANQAPDPFLPKSPLSVRWTGKLKPTVSGRYTFSFTSDDGCRLSINNQMLIDAWQAHAVSTDSASIYLEAGKEYQLKAEYYDNRDYAIAKLQWKVPQIGKATRLDLYGEAGKAVRECETVVAVMGINKSIEREGQDRYDIQLPADQREFLQEIYKVNPNIIVVLVAGSSLAINWMDEHIPAIVNAWYPGEQGGTAVAEVLFGDYNPAGRLPLTYYKSLDELPPFDDYDITKGRTYKYFKGDVLYPFGYGLSYSSFTYSDLQVKDGGGEVTVSFRLKNTGKRNGDEVAQVYVRIPETGGIVPLKELKGFRRVPLKSGESRRVEIKLDKEQLRYWDVEKGQFVVPKGAFDVMVGASSKDIRLQTVIDL

SEQ ID NO: 15180 - protein, 302 aa, Lactobacillus gasseri
MKVRKAVIPAAGLGTRFLPATKAMPKEMVPIVDKPTIQFIVEEAKKSGIEDILIVTGKNKRSIEDHFDANPELEQDLEEKGKTELLHLTQSITNLGVNLYYTRQPHPAGLGDAILRARSFVGDEPFAVMLGDDLMDDKVPLTKQLIDRYDKTHASTIAVMPVPHEEVSKYGVIDPDNEIEPGLINVKAFVEKPDVDKAPSDYAIIGRYLLTPEIFDILAHQKPGRGGEIQLTDAIDTMNKTQRVFAHVFNGERHDVGNKEGYLETSIEYGLSHPQIKDDLRKYIIAMGQKLQNEDKKTNKKK

SEQ ID NO: 15181 - protein, 139 aa, Zea mays
  unsure (1)..(139): unsure at all Xaa locations
PGTQXPAXRXDAXXARPDTQAKKQGNGKAKQANGKAXDPPPATGNPQKEAETKDKXERQXGNKEGQGGXKEGAKGGXTPXXTPETEGNSPKQQGADDNRXEGXAGRPQAAAHATXAAKEKEKDDEEDHXRRPAEXKARG

SEQ ID NO: 15182 - protein, 120 aa, Glycine max
IYSYGVLLLVLISGRRPLQVSASPMSEFEKASLISWAKHLARVSRLIDLVDPALKDVNQEEALLCITVALLCIQRSPARRPTSEELLRLLSGEGEPPHLPLEFSPSPPGGFHFKSRKKVR

SEQ ID NO: 15183 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLALLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 15184 - protein, 446 aa, Ahnfeltia fastigiata
  unsure (1)..(446): unsure at all Xaa locations
LFRVTPQPGVDPVEASAAIAGESSTATWTVVWTDLLTACDLYRAKAYKVDAVPNTPDQYFAYIAYDIDLFEEGSIANLTASIIGNVFGFKAVKALRLEDMRMPVAYLKTFQGPATGIIVERERMDKFGRPFLGATVKPKLGLSGKNYGRVVYEGLKGGLDFLKDDENINSQPFMXXKERYLYSIEGVNRAVAASGEIKGHYLNVTAATMEDMYERAEFAKELGSIIIMXXXVIGYTAIQSMAKWARRHDMILHLHRAGNSTYSRQKDHGMNFRVICKWMRMAGVDHIHAGTVVGKLEGDPLMIRGFYNTLLLPKLEVNLPQGIFFEQDWAALRKVTPVASGGIHCGQMHQLLDYLGIDVVLQFGGGTIGHPDGIQAGATANXXXXXXXXXXXXXXXDYVSEGPQILRDAAKTCGPLQTALDLWKDISFNYTSTDTADFVETPTANV

SEQ ID NO: 15185 - protein, 180 aa, Magnetospirillum magnetotacticum
MITRRWEFERMQLGMIGLGRMGGNIVRRLLRDGHTAVVYDRDPKAIEALTAEGATAAESLEDLVAKLEAPRTAWVMLPAGQITEETVTALGGLMAADDCIIDGGNSFYQDDVRRAQDLDRRGIHYVDVGTSGGVWGLERGYCMMIGGHKEAVDRLDPIFRTLAPGLGDIPRTPGREARDP

SEQ ID NO: 15186 - protein, 130 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAAPPYLCFAALLMAGLDGI

SEQ ID NO: 15187 - protein, 215 aa, Zea mays
LNGNQCGDAESVDVGGQPNALNLALQKPEFALVTTDSGIVLLHNSKVISTTKVNYTITSSSVSPDGTEAVVGAQDGKLRIYSISGDTLTEEALLEKHRGAITSIHYSPDVSMFASADANREAVVWDRASREIKLKNMLYHTARINSLAWSPDSRLVATGSLDTCAIVYEIDKPVASRVTIKGAHLGGVHGLTFLENDTLVTAGEDACIRVWKVVE

SEQ ID NO: 15188 - protein, 116 aa, Synechococcus sp. PCC 7002
MDLKSLIRDIPDFPKPGILFRDITTLLNHPEGMRYTMDALVQLCLEANLKPDHVVGMESRGFIFGPTLAYNLNAGFVPVRKPGKLPAAVHTVEYELEYGTDTLEIHQDAVGSGDKI

SEQ ID NO: 15189 - protein, 356 aa, Schizosaccharomyces pombe
MWGFIVTCGIFLVLLCQLRLLSKRKSKSTPYNALLPNVTVFAMGGTIAGCANSSLEIVNYIPGSVGIEKLIEAVPAIKAIANINGVQVTNMGSENLTPADVLKLAKLILAEVAKPNVHGIVITHGTDSLEETAMFLDLTISTAKPIVVVGAMRPSTAIGADGPMNLLNAVAVASSNQSMGRGTLVLLNDRIGSAFYTTKTNGNTLDTFKSYEAGSLGIVLNQKPFYFFSPAVPTGKVFFDIYNIKQLPRVDILYGYQGLNPKLAESAVHLGAKGLVLAAMGATSWTDDGNEVISSLIREHNIPVVYSHRTAEGYSSNSCLGIPSYFLNPQKARYMLMLAISSGYSIRDIEGLFSIK

SEQ ID NO: 15190 - protein, 443 aa, Wigglesworthia glossinidia endosymbiont of Glossina brevipalpis [sequence omitted]

SEQ ID NO: 15191 - protein, 175 aa, Zea mays
  unsure (1)..(175): unsure at all Xaa locations
MAPTVMMASSATAVAPFQGLKSAASLPVARRSTRSLGNVSNGGRIRCMQVWPAYGNKKFETLSYLPPLSTDDXLLKQVDYLLRNGWXIPCLEFSKXGFVYRENSXTSPCYYDGRYWTMWKLPMFGCTDAXTQVYKELQEXAIAAYPDAFHRVIGFDNVRQTQCVSFIAYKPPGSE

SEQ ID NO: 15192 - protein, 310 aa, Escherichia coli O157:H7 EDL933
MLDANKLQQAVDQAYTQFHSLNGGQNADYIPFLANVPGQLAAVAIVTSDGNVYSAGDSDYRFALESISKVCTLALALEDVGPQAVQDKIGADPTGLPFNSVIALELHGGKPLSPLVNAGAIATTSLINAENAEQRWQRILHIQQQLAGELVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 15193 - protein, 748 aa, Xanthomonas axonopodis pv. citri str. 306
MKPFTAHQNRPRPLVLAVVMGLGVAFAAPLAVAQGAPSSQPWMDTALTPDQRADRLLAQMSEDEKFQMLRSYFGLGTDKIPKPEGALGSAGYVPGIPRLGIPAQQLADAGVGVTNPGGIRKGDYATAMPSGPSTASSWNRQLAYTGGKTMGRESWQQGFNVLLAGSVNLQRDPRNGRNFEYAGEDPLLAGTMVGESIRGVQSEHVLSTMKHFALNDMETRRNFHSAQIGEQAMHESDLLAFEIALKIGDPASVMCSYNKINGIYGCEHDYLLNQVLKQEWKYPGYVMSDWGGVHSGSKAALAGLDQQSAGEVFDAAVFFDAPLRMAVSAGVVPRARFDDMVKRVLRSLFAHGAFDHPTQRQPIDGKAGLLAAQRVAEEGSVLLRNEQAALPLSKDVRRIAVIGGYADKGVMSGGGSSRVDYTINGGNAVPGITPTTWPGPVIIHPSSPLQALRAALPNVQIDYLDGTDRAAAARAAKAADVAIVFATQWAAESVDLPDMRLPDNQDALIETVAKANPKTTVVLETNGPVRMPWAERVPAVLQAWYPGIGGGEAIANLLTGAVNPSGHLPVTWPVDESQLPRPSIPGLGFKPAKPGEDSIDYAIEGANVGYKWFAARKLTPRYPFGHGLSYTQFRMGGLQVEARGSQLTASFEVENTGPREGAAVPQLYVALPDGHATPLRLIGWQKLTLKPGEKRSVQVVAEPKTLADFDAKARRWTIAAGTYRVQLARSTSEPVQTAEVTLQAAQLP

SEQ ID NO: 15194 - protein, 354 aa, Pneumocystis carinii f. sp. ratti
MGCSPLQSYKQDTSRSREIELYLRRDQEEAIHEAKILLLGAGESGKTTILKQMKLIHLSGFTLKEREYYRTIIFSNMLQAMRLIIEAMEEFDICFERRENEQYLDLLLQERELTDRENLPPEYYRPFISLWEDAGVMRAVNRGNEYALHDNCFSFFENIHRLFERKYIPTDQDILRCRLKTTGITETCFKVSRLTYRMIDVGGQRSERRKWFHCFENVTAVLFLVAISGYDQCLAEDIGANQMQEALVLFDSICNSQWFINTSIILFLNKIDLFRVKLHVSLISNYFPDFNSEHQTDYRASCLFFRQKFLKLNRNHQKTIYTHFTNATDTTLLKSVMISVTDIIFNRNLQNLML

SEQ ID NO: 15195 - protein, 329 aa, Chlamydophila pneumoniae AR39
MPMSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATEKLAEGIRIFAGDTQILETAITEFIKQIAAEGA

SEQ ID NO: 15196 - protein, 381 aa, Streptomyces avermitilis MA-4680
MTVMEQRGAYRPTPPPAWQPRTDPAPLLPDALPHRVLGTEAAAEADPLLLRRLYAELVRGRRYNTQATALTKQGRLAVYPSSTGQEACEVAAALVLEERDWLFPSYRDTLAAVARGLDPVQALTLLRGDWHTGYDPREHRIAPLCTPLATQLPHAVGLAHAARLKGDDVVALALVGDGGTSEGDFHEALNFAAVWQAPVVFLVQNNGFAISVPLAKQTAAPSLAHKAVGYGMPGRLVDGNDAAAVHEVLSDAVAHARAGGGPTLVEAVTYRIDAHTNADDATRYRGDSEVEAWRAHDPIALLEHELTERGLLDEDGIRAAREDAEAMAADLRARMNQDPALDPMDLFAHVYAEPTPQLREQEAQLRAELAAEADGPQGVGR

SEQ ID NO: 15197 - protein, 150 aa, Aspergillus fumigatus
  unsure (1)..(150): unsure at all Xaa locations
ACGLLTVVLSAANSNVYSGSRILIGLAQEGFAPRLFXRTSKKGVPYYSVAFTSAFGLLGFMNVSNAGSTVFNWFLNISGVAGFITWASLNACHIAFMRALKARNISRDLLPYKALWQPWYAYYGLFFNVLIILTQGFTAWIPTFSVTVVG

SEQ ID NO: 15198 - protein, 101 aa, Zea mays
  unsure (1)..(101): unsure at all Xaa locations
MAKHDPELMVCRSQPAMPIGRLCEKRDGXCVDCNSFVRPWTLNRLWDKCNGGPFQGRCQICRGVPISYTYYCTDATHHDNDRDGCPKIVTLRSAKTDLFDE

SEQ ID NO: 15199 - protein, 331 aa, Methanothermobacter thermautotrophicus str. Delta H
MYRITVIPGDGIGVEVMEAALHVLQALEIEFEFTHAEAGNECFRRCGDTLPEETLKLVRKADATLFGAVTTVPGQKSAIITLRRELDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEANDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLMRGIMTPDLGGTASTMEMAEAIKEEIVKGE

SEQ ID NO: 15200 - protein, 319 aa, Mallomonas rasilis
SKVGINGFGRIGRLSLRAVKGHPNVKVVAINDPFIPLDYMKYMFYYDSVHGKYDGTVTIDNGKLIVDGTPITVSNEREPEKIKWGDAGAEIVLESTGKFLEEAGAAKHFVGGAKKVVMSAPSKDATPMFVMGVNHFEYKGQKIVSNASCTTNCLGPLAKVINDNFGIQEGLMTTVHAATATQPTVDGPSVKDWRGGRGAVGGNIIPSSTGAAKAVGAVIPALKGKLTGMAFRVPTANVSVVDLTCVLTKGAKYSDIKAAIKAASEGPMKGILGYTEDSVVSTDFISDPRSSIFDAGAGIALNDKFVKLVSWYDNEWGYS

SEQ ID NO: 15201 - protein, 148 aa, Zea mays
LLQPRFLTKYATAARRAAYPQWRSPPPPRSPLPPESSAASLLLKTLAPLPRPFLGQAMVDFSGMVDDEFLDRLGIEKGTRKVINHEERGRVLRAMDGCSYKAAAGGSLSNSLVALARLGSSQSAGYPELNIVMGGSVGSDPLGSFYRA

SEQ ID NO: 15202 - protein, 425 aa, Rhodospirillum rubrum
MAEIIDIHAREILDSRGNPTVEVDVLLDSGAFGRAAVPSGASTGAHEAVELRDGDKTRYAGKGVLKAVEAVNGELFSALSGLDATDQLLIDQAMIDLDGTPNKARLGANAILGVSLACAKAAAEEAELPLYRYIGGARSHILPVPMMNIINGGQHADNPIDVQEFMIMPVSAPTVADAVRMGAEVFHALKKKLKDAGHNTNVGDEGGFAPNLASADEALAFIVKAIEAAGYKAGEDIVLALDAASSEFYKDGKYVLAGEGKTLDAEGMVKYYAELCKRYPILSIEDGCAEDDWAGWSLLTAELGAKVQLVGDDLFVTNPLRLAEGIRKGVANSILVKVNQIGTLSETLEAVEMAHKAGYTSVLSHRSGETEDSTIADIAVATNCGQIKTGSLSRSDRLAKYNQLIRIEEELGPVAVYAGASILRG

SEQ ID NO: 15203 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 15204 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 15205 - protein, 422 aa, Pseudomonas syringae pv. tomato str. DC3000
MSDLKTAALEYHANPRPGKLSVELTKPTATARDLALAYSPGVAEPVREIARDPELAYKYTGKGNLVAVISDGTAILGLGDLGPLASKPVMEGKGVLFKRFAGIDVFDIEVDSESPQAFIDTVKRISITFGGINLEDIKAPECFEIEKALIEQCDIPVFHDDQHGTAIVTAAGMINALEIVGKSLESAKIVCLGAGAAAISCMKLLVSMGAKIENIFMVDRTGVIHSGRTDLNQYKAVFAHATEKRSLTDALDGADVFVGLSGPNLLSAENLKLMAKDPIVFACSNPDPEISPELAHATRSDVIMATGRSDYPNQVNNVLGFPFIFRGALDVRAKRINEEMKIAAANALRELAKLPVPQEVCDAYGGIKLEFGREYIIPKPMDTRLLGLIADAVAKAAIESGVATLPYPKHYPLTSVDDVFNG

SEQ ID NO: 15206 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAIVLPLELTVCGFTVGYWNQDITVWITIFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEAKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 15207 - protein, 344 aa, Pseudomonas fluorescens PfO-1
MKPSRLPRMSRRSSRPMNAIDCMSQPYKEQTTMYLVCGEALFDFFSEDDAGGQASKVNFKAIAGGSPFNVAVGLRRLGVDSALFGGLSTDYLGRRLQQVLQDEGVHPDYLVDFAAPTTLAMVAVGANGSPHYSFRGEGCADRQLSLAHLPALGPEVRGLHFGSFSLVVQPIADTLLALVQRESGKRLISLDPNVRLNPEPNIDLWRERIATLVPLADLIKVSDEDLSLLYPEQDPARVIEGWLQHRCQVVFLTRGGEGATVFSRVHGSWSVPASSVKIADTVGAGDTFQAALITWLTEHELDSVEGVQHLSREQIDGMLRFAVQAAALTCSKTGPDLPYRHQLT

SEQ ID NO: 15208 - protein, 212 aa, Griffithsia japonica
HEGLTPTAVSSGRAAVPRDRSSIPNSPLPNPQPPPDQSVLDAISSAPPPGSDPSTLSSDVPLVTPPVAAVAQPVPPPSTIPPTQSTYPTAAPPPTTVSASPSKPASASPVTQTDDIAASWARKGRANAISRTVEIWAFFFTTVTAELKNRKIEDKAELALARRESARRLKDGLLRLGPTFIKLGQLLSTRVDVVPKEYIEELSVLQDRVPGF

SEQ ID NO: 15209 - protein, 528 aa, Thermoproteus tenax
MGIRLSMSGKVTYVSVLADESIHPAYEKALSEVWELLGREWPIYIGGKEVYTSGKFEKRSPFDTSIKIGTFQRGTPEEFKAALSKAVEAFPEWSRLDWRERARILAKLADLIERDRFKLAAAITYEVGKNRFEALAEIHEAIDVLRYYVELIHKMDGYVLQMRSPIPNERPLSVLRPYGAWFVISPFNFPIALAKGMLTGVLLMGNTAVWKPTSEAPFTAALVYQLAVEAGVPPGVLNFVTGPGDAVEEVATGDPRVAGIAFTGSRDVGMRLYRLFTQRQPWPKPIVLEMGSKNPTVVTAKADLEKAAEGVVRAAFGFGGQKCSATSRLYVQREVYDRFVERLVEKTREIVKIGDPRRREVFLGPVINKSARENYRRYVADAVAAGGRLRYGGRVLEEGEFSKGFYVEPAIIEGVAPDSYLWKTELFLPILLVDKFDTLEEAVRKANDTEYGLTAGIFSEDPKEVEYFFEHIEFGVVYANRRGGATTGAWPGAQPFTGWKASGATGRGVNGVYYLLNFAREQARTVVY

SEQ ID NO: 15210 - protein, 254 aa, Sinapis alba
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKEREKVLRAQQEQWDEQNHGHNMPPPPPLQQQIQHPYMLSHQPSPFLNMGGLYQEDQIAMRRNDLDLSLEPVYNCNLGCFAA

SEQ ID NO: 15211 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 15212 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVTVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 15213 - protein, 65 aa, Glycine max
  unsure (1)..(65): unsure at all Xaa locations
FLQQATMICIDNSEWMRNGDYSPSRFQAQADAVNLICGAKTQSNPENTVGXLTXAGKGFFGPLEV

SEQ ID NO: 15214 - protein, 423 aa, Aspergillus niger
MGDVAVETPANNVTPLTKAAPLDTIPNIDSLEGTGNDGSDEYATLKRLQRHLEYIQLQEEYIKDEQRSLKRELVRAQEEIKRIQSVPLVIGQFMEAIDQNTGIVQSSTGSNYVVRILSTLDREKLKPSSSVALHRHSNALVDILPPEADSSIAMLGENEKPDVTYADVGGLDMQKQEIREAVELPLTQFDLYKQIGIDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQSSNVKVIMATNRADTLDPALLRPGRLDRKIEFPSLRDRRERRLIFSTIASKMSLSPEVDLDSLIVRNEPLSGAVIAAIMQEAGLRAVRKNRYNIIPRSDLEDAYAAQVKTGQEADRLEFYR

SEQ ID NO: 15215 - protein, 495 aa, Zea mays
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGERCILTDEEARVGGRNHSHTQDLYDSIAAEGSFPEWTLYVQVMDPAQEEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVKAIRRLARTPKGQPELRSIWIDLLAKVDASLGMKIATRLNMKANM

SEQ ID NO: 15216 - protein, 115 aa, Glycine max
  unsure (1)..(115): unsure at all Xaa locations
NSARATYPASFKDGYSNVSVYSRGDYPVVAESIAADDALELTLSPETVSYVSTXGPIPDHADACIHVENTETVNDAFDGSKSVSILLQTTKGNEIRPVGVDIEKDAAVSTSGERL

SEQ ID NO: 15217 - protein, 106 aa, Zea mays
  unsure (1)..(106): unsure at all Xaa locations
TELYRSCGALSHDKNSGEGCSHINLQGQDDTMSTRSSPRIKKATQLNKLMNXYCHRQSEDMXMSIAFLLDVRTVRGNQTPDDLEMKDGDYTHAMIHQTAGGDTTPT

SEQ ID NO: 15218 - protein, 546 aa, Caulobacter crescentus CB15
MPDRRRFAGRWGNAHMAGNRLFLKKSIASIQKEAAHSQLKRTLGPINLMSLGVGAIIGAGIFVLTGQVASANAGPAIMLSFIVAGIACALAGLCYAELASTMPVSGSAYTYAYGTLGEVFAWIMGWLLVLEYGVAASTVAVGWSGYVVSTLHALGINFPMIQVAGADAPMWATPLIQAVAAPGGGTMFAMTGTLNLVAAIGIAMVSALLVVGVSESANVNNAIVVIKVIVLVTFIAVGAQYINPANWHPFIPEPTGQPGEFGIGGIFRGAAIIFFAYVGFEAVSTAAAEAKNPSRDVPIGILGALIICTLIYMAVAAVMTGVVPFRELASPAPIAVAIDRMGLEWADIPYAAAEGGKLNLLSFAIKIGAITGLSSVMLVLCYGQTRIFYTMARDGLLPKVFAEIHPKFRTPWLGTILLGVVIAIAASFLPISLLGDLVSLGTAVAFSIVCLSVIYLRIKHPDLPRPFKVPGGIFTAAAGIAACLFLPYQNFQPMIVHAMNDNPLPLMILGGYAAVGAIIYIAYGYWHSKLAKGIDITEETDPNSPA

SEQ ID NO: 15219 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 15220 - protein, 291 aa, Medicago sativa
GENVEKIGEGTYGVVYKARDRVTNETIALKKIRLEQEDEGVPSTAIREISLLKEMQHRNIVRLQDVVHSDKRLYLVFEYLDLDLKKHMDSSPEFIKDPRQVKMFLYQMLCGIAYCHSHRVLHRDLKPQNLLIDRRTNSLKLADFGLARAFGIPVRTFTHEVVTLWYRAPEILLGSRHYSTPVDVWSVGCIFAEMANRRPLSPGDSEIDELFKIFRILGTPNEDTWPGVTSLPDFKSTFPRWPSKDLATVVPNLEPAGLDLLNSMLCLDPTKRITARSAVEHEYFKDIKFVP

SEQ ID NO: 15221 - protein, 474 aa, Glycine max
  unsure (1)..(474): unsure at all Xaa locations
MSVQDYLDKHMLSRKLEDAVNAAVRAKTSDPVLFISNHMRKAVQSVITKIKARQILDSRGIPTVEXVDLHTNKGVFRASVPSGNSTSMYEAVELRDGVTXQRSGNGVAKAVKNINDKISEALIGMDPTLQSQIDQAMIDLDKTEKKGELGANAILAVSIAACKAGAAEKEVPLYKHIADLSGKTSPTLPVPAFTVISGGKHAGSNLAIQEIMILPIGASKFEEALRMGTETYHHLKAVITEKYGAHNCNVGEDGGFAPNISSFREALDLVKEAISRAGYDEKIKIALDVAATDFCIGKRYDLDFQSPQKSGQNFKSAEDMIDLYKELCSEYPIVSIEDPFDKEDWEHIKHISSLGICQVVGDDLLMSNAKRIERAITESACNALLLKVNQVGTITEVIEVVKLAKEAHWGVVTSHRCGETIDSFIADLSVGLASGVIKAGAPCRGERLEKYNQLLRIEEELGDQAVYAGEDWRQ

SEQ ID NO: 15222 - protein, 260 aa, Streptococcus thermophilus
MKWRISCQKRTYYRSNLRHWRTYGACLCQRGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKEDKAAKVYQGLEALQAQDIAEAVLYVTKQPRRVQISDMTIMANQQATGFTIHRGE

SEQ ID NO: 15223 - protein, 150 aa, Chlamydia muridarum
MQLTSQAFSYGRPIPKKYSCQGVGISPPLSFSDIPSEAKSLALIVEDPDVPANVREDGLWIHWIVYNLSPIVSNLAEGAQIFAVQGINTAGEIGYCPPCPPDAKHRYYFYAYALDVVLPEEEGVTKEQLLEAMEGHILATAELMGTYEQD

SEQ ID NO: 15224 - protein, 410 aa, Bradyrhizobium japonicum USDA 110
MNSPTPLRFHVPEPASRPGGKPDFSGVSIPKAGSVRRPPVDVLPEEIRDLAYSIIRVLNHEGRAIGPWVPDLSLDELVAGLRHMMTLRTFDARMQMAQRQGKTSFYMQHTGEEAVSCAFRIALGPDDMNFPTYRQAGLLIAHDYPLVDMMCQIYSNEHDPLKGRQLPVMYSSKRHGFFSISGNLATQFVQAVGWAMASAIKRDNRIAAAWIGDGSTAESDFHAALVFASTYKAPVVLNVVNNQWAISTFQGIARGGSGTFAARGLGFGIPALRVDGNDYLATYAVAKWAIERARLNLGPTLIEYVTYRAGAHSTSDDPSAYRPKHESEEWPLGDPVIRLKQHLIAAGAWSEERHKQTEAEILATVIAAQKEAEAFGTLHSGGKPSARDIFEDVYAELPPHLRRQRQQIGV

SEQ ID NO: 15225 - protein, 506 aa, Oryza sativa
  unsure (1)..(506): unsure at all Xaa locations
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGXVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 15226 - protein, 186 aa, Glycine max
  unsure (1)..(186): unsure at all Xaa locations
MSAYRDEDPRLHGIKTKIRVVPNFPKPGIMFQDITTLLLDPRVFKDTIDLFVERYKGKNISVVAGIEARGFIFGSPIALAIGAKFVPLRKPKKLPGKVISQEYILEYGRDCLXMHVGAVEPGERALVVDDLIATGGTLCAAMDLLERVGPKVVESGCVIELPELKGRERLNGKPLHVLVECFESCE

SEQ ID NO: 15227 - protein, 683 aa, Arabidopsis thaliana
PVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQSYDSVNLLLSLQGEKGGLTAWEPVRPQEWLELLNPTDFFTCVMAEREYVECTSAVIQALVLFKRLYPDHRTKEIIKSIEKGVQFIESKQTPDGSWHGNWGICFIYATWFALSGLAAAGKTYKSCLAVRKGVDFLLAIQEEDGGWGESHLSCPGQRYIPLEGDRSNLVQTAWGMMGLIHAGQAERDPTPLHRAAKLVISSQLENGDFPRQEILGVFMKTCMLHYATYRNIFPLWALAEYRKAAFATHQDL

SEQ ID NO: 15228 - protein, 354 aa, Photobacterium profundum
MKNNLIRLGMVVAGLCFSTFSFASADLPNIKILATGGTIAGAGQSATESNYTSGKVGIDELIAAVPDMTKIADISGEQVVKIGSQDMSDEVWLTLANRVNALLAQDDVDGVVITHGTDTMGETAYFLDLTVKSDKPVVLVGAMRPSTAMSADGPMNLYNAVVTAADKDSEGRGVLVAMSNNVFDARDVTKTNTTSVDTFQSPNFGTLGYIHNGDVKYQRSPERKHTSDTVFDVSKLKELPKVGIVYNYANASDLPVKALIDAKYDGIVSAGVGNGNMYHTIFDQLVKASKDGTMVVRSSRTPTGSTTLDAEVDDAKFGFVASGTLNPQKARILLMLSLTQTQDYKEVQKMFQFY

SEQ ID NO: 15229 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEIRKHDPDSNQRDLFDAIARGDYPKWKLSIQVMPEEDAKKYRFHPFDVTKIWYTQDYPLMEVGIVELNKNPENYFAEVEQAAFTPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 15230 - protein, 338 aa, Shewanella oneidensis MR-1
MIRVAINGYGRIGRSILRALYESGKRQQIQIVAINELAKPEAIIHLTQYDTTHGRFQPRVKLVDGQMQIGDDTIKIFHEPDPAKLPWRELDIDIVYEATGAILDRQSCEAHIHAGAKQVLISHPSSADVDGTIVYGVNHDLLRAEHTVVSNASCTTNCIVPVIDVLDKHFGVKSGAITTIHSAMNDQQVIDAYHDDLRRTRAAGQSIIPVDTKLARGIERILPHMKDKFEAISVRVPTINVTAIDLSVTLDKTVDIATVNQVLELAANGRFNGILGYTDEPLVSCDFNHDPRSSIVDGTQTRVSAGQLVKLLLWCDNEWGFANRMLDTSLAMIAAKQS

SEQ ID NO: 15231 - protein, 349 aa, Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 15232 - protein, 555 aa, Thermoanaerobacter tengcongensis
MRIPLFLRNREIYKRYRDILKILTKNGFGFIVDILSRGGRVPFYLLRGHDVMEIGERIRNTLEELGPTFIKLGQLISTRADLIPHDILIELSKLQDEVAPEEFESIKKVLESELGGNIEEFFSYFEEKPLASASIGQVYRARTKEGKDVVVKVQRPEVDKKIHADVVILKNIARILNERIVDSPVDFVEIVEELTDSLLNELDYTQEGNNADRFRENFKNQDYIYIPEVYWDYTTKRVLTMEYIDGISVKNKEILREKGYDLKRIARNGAWSIFLQVYKYGLFHGDLHPGNILITKEGKISYIDFGIVGYLDKSSREVLIELFKAFAENDTEEVIEILSDIGAIRADTNLRNLKADLGRIINYFYTTPLKNINVNDSMRRIMGVVYKYKLMLPPGFTLLLKALATVEGVGRDLDPDFSISDVARDFVKEMYLKKIDVKEVIKENYKDLHKTLIILRKFPLRLQSIMTKLIKDDIKVRINIDESESLRYDLNVMINKVIVSIIASALIVGSSLVLTYGGGYKIFGYNAIGFFGYVIATMLSLWVFYRIFIVERKKK

SEQ ID NO: 15233 - protein, 216 aa, Oryza sativa (japonica cultivar-group)
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEE

SEQ ID NO: 15234 - protein, 628 aa, Zea mays
MSARLLRRVLQEREATPQDTDVADDDQSVEEEASPPRTSARNLFDLLDDGNGDGDEEDEKEDETEIIQAVSYTEQRHSVQKKANAVPETNKKSKKKKKKSKAEPSSTKAKDAQSLESILEDLCIEKNPIQQRAHQSDRAAGKEFETNEATHVASSVLAIDPKHLKGENEMRRIFGSKVVDSFENQRSMPSSSRQVRGARRVAHNPRKTLLVSPPSYWPPWDKSITMDLLEMKNGLNYFRYTYDPSVSHVQELFEAAKAANDLNAIAAILGKYPYHPESLLTFAELFKYSGEHQSSADAVEKCLFALECAWHPLFSPLQGNYQLKFNHDTNKPLFTALFSHMKNLDRRGCHRSALEVCKFLLSLDFDDPKGSLFCIDYFALRSQQYKWLEQFAEEYQCDNSLWLFPNFSFSLATARFYLECDAASEGSDDADKSTSLDLMKQALMLHPMVLRKIVDKAPLKDSSWTQILRNVFFGSAKPGSPSLEHMINIYVERHYIMWRFPELQNLLKEAALLVIESLKQDNREALDWACVRKEAFSSDKNEYSHLLVSDFTDTTPSLPPEELRPFMVGPGMLHEMPPVEQEAGPERLRAPREVAGRNPAVVFLESLLPWVDYGDNHQGANDDDNDDE

SEQ ID NO: 15235 - protein, 708 aa, Nicotiana tabacum
MNHRQDEFVRFQDWKSERSSEGNFHAKGGVHRSKVVIASDELHNRLESGKWRAKGIIQAVKSSLSGFVEESLGSKKNILDPQGPFLRKWNKIFVLSCVIAISLDPLFLYIPVIDNDNKCLGLNRTLEVTASVLRSFTDIFYFLHIALQFRTGFIAPSSRVFGRGVLIEDAWEIAKRYLSTYFLIDILAVLPLPQVVILIIIPKLRGSRSLNTKNLLKSVVFFQYIPRVLRVYPLYREVTRTSGILTETAWAGAAFNLFLYMLASHVLGAFWYLFSIERETTCWKQACGNSSPCHHASLYCDDDHTKFKTLLNSSCPIETPNATLFDFGIFLGALQSGVVGPMDFPQKFFYCFWWGLQNLSSLGQNLQTSTFIWEMCFAVFISIAGLVLFAFLIGNMQTCLQSSTLRLEEMRVKRRDAEQWMSHRLLPENLRERIRCYEQYRWQETRGVDEENLIHNLPKDLRRDIKRHLCLALLMRVPMFEKMDEQLLDALCDHLKPVLFTKDSFIVREGDPVDAMLFVMRGKLLSVTTNGGRTGFFNSEHLKAGDFCGEELLTWALDPNSSTNLPISTRTAQALSEVEAFALVADDLKLVASQFRRLHSKQLRHTFRFYSGQWRTWAACFIQAAWRSYCRKNVEESLRDEENRLQDALANEGGSSPSLGATFYASRFAANVLHALRRNTAKKARVPDRISPILLQKPTEPDFTAEDN

SEQ ID NO: 15236 - protein, 201 aa, Leptospira biflexa
MKVLILDNYDSFTFNLYQIVGEILEEREKPFQLDVIRNDEKPFEWIKSANYDKIIISPGPGHPADPAYFGVSADILKELGKTPPVLGICLGMQGMATVFGGEVVRANIAMHGKLSPIEHDGKGVFSGLTQGIEIMRYHSLVAKEISLPNDLEITARVSAGEGKGEIMGLRHKSLKIEGVQFHPESFGSEEGKCLLRNFINS

SEQ ID NO: 15237 - protein, 484 aa, Acinetobacter sp. ADP1
MTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 15238 - protein, 257 aa, Eremothecium gossypii
MSERRLEEHGTAETADVEMADAVETNSTGSSDYVELWIDLFLGKKGHEYFCDVDTEYITDRFNLINLQKTVSKFTQVIQYMVDELDDTTLEAMSRTKLTQLEADARKLYGLIHARYIITIKGLQKMLQKYRDADFCRCPRVHCNFQPLLPVGLHDVPGIDCVKLYCPSCEDLYIPKSSRHSSIDGAYFGTSFPGMFLQAFPEVVPKHPTKRYVPKVFGFDLHKQAQLARWQELQRLKLERELIKKGVDLTKNGGYKK

SEQ ID NO: 15239 - protein, 296 aa, Triticum aestivum
  unsure (1)..(296): unsure at all Xaa locations
MAHDEAVAAQKTGKSGSPPKDQPAPSPYPDWSAMQAYYSSGVMPPAYFAPAMAAGHPPPPYMWGPQHMMPPPFGTPYAMYPHGGAYPHPLVPMMASPLSVEPAKSANSKDKSSNKKLKEIDGSAVSTGSGNSKKTSSSXRSTGEGSSDVNDLKVSATPRKRSWDGGFDAQATAAAWNKDVVASSPIIRNGAILSNQCFPAPVIKPSVTNVANSRAIGTPASPLPGFTAPIHTGISTELSSKDEREVKREKRKQSNRESARRSRLRKQAETDELATHVRSLTAENTCVICEIGKLTK

SEQ ID NO: 15240 - protein, 500 aa, Novosphingobium aromaticivorans
MRALRAGATVHVWRRPASRGTDTNPQREGEKGMSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 15241 - protein, 359 aa, Buchnera aphidicola (Schlechtendalia chinensis)
MNIKQLVRKNIQELQPYQSARTIGGKGDIWLNANECPTFNRLKLENIFLNRYPECQPRELLLRYSSYIGLDKKNILITRGSDEAIELLIKTFCEPQCDRIVFCPPTYDMYNVSANIMGVECLQIPLLNHSWQLDLKVIKKCINNFKLIYLCNPNNPTGSLINFRDVLALLKMTYGKSLVIIDEAYIEFSPMNSLVNLISQYSNLVVLRTLSKAFSLAGLRCGFVLANFSVIKFLLKVINPYPISTPTSSIAIQFLSNINISKMQDRVFSLILNRCWLINELKLISNCIDHIFYSASNYVLVRFRNSNKVFHELSNQGIIVRDQSKKINLKNCIRISIGTSQECLKVIHAIRKIDCLYVN

SEQ ID NO: 15242 - protein, 409 aa, Triticum aestivum
  unsure (1)..(409): unsure at all Xaa locations
MAAATTTTSRPLRLSRQQAAASSLQCRNQPLSGSRPGVDSEQASPPNVRRMAVVDSGAAPEEEQLRQRSSXDMITLTXEQEGVIENEMTIVLSSISTACKQIASLVQRAPISNLTGVQGATNVQGEDQKKLDVISNEVFSNCLRWSGRTGVIASEEEDVPVAVEESYSGNYIVXFDPLDGSSNIHAVESTGSIFRMYSLSDECHIGDDANCRRXTLDELTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 15243 - protein, 651 aa, Brucella melitensis 16M
MSGELNGNDTSAQAAVSAGSVLEGAAFADEGEQHNESMKTLVLGALGVVYGDIGTSPIYAFREALHAAATNGILARSDILGVVSLIFWALTLVVTVKYVLFVLRADNNGEGGILSLMALVRGALKGRPDLILGVGICGAALFFGDAVITPAISVLSAMEGLEIVAPNLTPFVVPATVVILVTLFSVQKLGTGRVAIVFGPIMALWFVALGASGLWHIFDDPTVMAALNPYYAVRFLTVSPAVAFVTVGAVFLAMTGAEALYADLGHFGRKPIVRAWLWIVFPCLLLNYFGQAAFILSHGEAAALPFFQMIPSFALWPMVLLATAATVIASQAVITGAYSVARQAVQLNILPRLEIQHTSEKLHGQIYIPRVNLLLGLAVVILVLGFEKSSNLAAAYGIAVTGNMLVTTVLLYIVMTRIWNWRVSRALPIILGFLVIDMLFFSANIIKVHEGGWASIGIATVLVLIMWTWVRGTRHLFQKTRKAEVPLDLIVEQMAKRPPTIVPGTAVFLTGDPKSAPTALMHSLKHYKVLHENNVILTVVTASKPWVASADRARVSQYNERFMLVTLTFGYMQQPNIPRALGLCRRLGWKFDIMTTSFFLSRRSLKASVHSGMPLWQDKLFILLARTASDATEYFQIPTGRVVEIGTQVNI

SEQ ID NO: 15244 - protein, 203 aa, Torenia hybrida
AHLKGGAKKVVISAPSKDAPMFVVGVNEKEYKPELDIVSNASCTTNCLAPLAKVINDRFGIVEGLMTTVHSITATQKTVDGPSSKDWRGGRAASFNIIPSSTGAAKAVGKVLPVLNGKLTGMAFRVPTVDVSVVDLTVRLEKEATYDEIKAAIKEESEGNLKGILGYTEDDVVSTDFVGDSRSSIFDAKAGIALSKTFVKLVS

SEQ ID NO: 15245 - protein, 301 aa, Rhizobium sp. NGR234
MDRIRTVRKAVIPVAGNGTRFLPATKAVPKEMLTIVDRPVVQYAVDEARQAGIEHIVFVTSRNKQVIEDHFDDTPELISSLSRSGKNAQISELEAMLPKAGSVSFTRQQAPLGLGHAVWCARDLIGDEPFALLLPDMVSYGARGCMAGLMDLYREVGGNVVAVEQCAPEEASKYGIVGKGDTVRHGFSVTEMVEKPPAGQAPSNFYLNGRYILQPEIFSILAHQARGAGNEIQLTDGMLNLSADQPFHAHPYEGRTFDCGSKQGFIEANVAFALARADIGDVVFESVREIVLSHESRIRAA

SEQ ID NO: 15246 - protein, 345 aa, Ralstonia eutropha
MALISLRQLLDHAGEFGYGVPAFNVNNLEQIHAIMEAAEETDSPVILQASAGARKYAGEAYLRHMVLAAAETHPDIPIVLHQDHGSSPAVCQASIRSGFTSVMMDGSLREDMKTPSDYDYNVDVTRRVCEMAHAVGVSVEGELGCLGSLETGQAGEEDGVGAAGTLSHDMMLTDPAQARDFVARTGVDALAIAIGTSHGAYKFSRKPTGDILAIDRIREIHEQIPDTHLVMHGSSSVPQEWLEIIRQYGGDIKETYGVPVEEILRGIKTGVRKVNIDTDIRLAMIGAIRKSLAEDRSEFDPRKALLAAKKGARSVVKLRFEAFGCAGQASKIKPIAMEQLAQWYR

SEQ ID NO: 15247 - protein, 256 aa, Brassica oleracea var. botrytis
MGRGKVELKRIENKINRQVTFAKRRNGLLKKAYELSVLCDAEIALLIFSNRGKLYEFCSNPSGMAKMVEKYRKHSYATMDPNQSAKDLQERYQDYLNLKSRVEVLQHSQRHLLGEEIAGIGVDELEQLECQVDTSLRQIRSTKARSMLDQLSDLKSKEEMLLETNRDLKRKLEESDAALNQTLWGASSSAEHSQQQQEGMTSYHANPLSQEVGFFRPLQGNVALQMSHYNPGVPNASNSATTSQNVINGFFPGWMV

SEQ ID NO: 15248 - protein, 276 aa, Glycine max
MEGMAPNSCARPVVEKKARPQEQLNCPRCNSTNTKFCYYNNYSLTQPRYFCKTCRRYWTEGGSLRNVPVGGGSRKNKKVSVTASSSPKVPDLNPPNHSAISSHNPKIMHGGQDLNLAFPAMEKYHHHGMSPYNVEMQNSNTTTTHHHHQTSPSCSAPPANSLSALELLRSSMASRGLNPYAPNSSLMPNSTNNNNNALYPSGFPMQEVKPSLNFSSVDGIGNNRSYDQERGGGRVLFPFGDVKQLSAAAGAADQVEQQQQGNSTGYWTGMIGEGTW

SEQ ID NO: 15249 - protein, 470 aa, Escherichia coli CFT073
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLSVIILLLVLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFSLIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLVLLTLEDDTRQALLVTPLWFIALGLGWLFIGKKRAAELRK

SEQ ID NO: 15250 - protein, 382 aa, Lolium perenne
MVQPVFDAALLSGQSDIPSQFIWPADESPSPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNGTLGTGPHCDPTSLTILHQDDVGGLQVHADGRWLSIRPRADAFVVNIGDTFMALSNGRYKSCLHRAVVNSRVPRKSLAFFLCPEMDKVVAPPGTSVDEANPRAYPDFTWRALLDFTQKHYRADMKTLEVFSDWIQQGHQPAATTTTTQDQRTYTASASLHLLACCT

SEQ ID NO: 15251 - protein, 178 aa, Glycine max
  unsure (1)..(178): unsure at all Xaa locations
RNSRGSVDSWFSGELRGIRWNSYDSGTGSGAKSGGVSSTPSMRGTVFYVAPEYGYNGDASEKCDVYSFGVLLLVIVSGRRPLXLTGSPVSEFQRANLVSWARQCARRGKLLEMVDESVEGMDKEQASMCVTAALMCLLKSPARRPSMKEVVGMLSGEMEPPLLPXEYSQQAKFTFKSR

SEQ ID NO: 15252 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 15253 - protein, 473 aa, Triticum aestivum; identical to SEQ ID NO: 7644

SEQ ID NO: 15254 - protein, 550 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEGEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGP

SEQ ID NO: 15255 - protein, 103 aa, Brassica rapa subsp. pekinensis
WEVDESSSASEEPAILVGGKKHERNSWFRIERKEPFYGGVAYKFSTLTGTIGTVPGHWDQAPQLVLTNDTAKTFLVKFHKVHGDTPATTSRQEKLGLRMFPFY

SEQ ID NO: 15256 - protein, 163 aa, Oryza sativa
  unsure (1)..(163): unsure at all Xaa locations
MAPIVIASLATSVAPFQGLKSTAGLPVSRRSTNSGFGDITNGGRIKCMQVWPVDGKKKFETLSYLPLLTAEDLLKQIEHLLXSEWVPCLEFSDVGFIYCGNHRSPGYYDGRYWTIWKLPMFGCSDNSQVIKELEEAKKAYPDAFIHIVGFDNVRHVQCISFIA

SEQ ID NO: 15257 - protein, 378 aa, Streptomyces coelicolor A3(2)
MRTTVGWQATGPTLRRAPLERRDLRPDDLAVRVDYCGVCHTDLHAVRAGAADGSGPRPLVPGHEFTGVVTETGTAVTRFRPGDPVAVGNIVDSCGTCAMCRIGQENFCHSFPTLTYGGTDRRDGSTTLGGYSREYVLGERFAYALPAALDPAAAAPLLCAGITVWEPLRALGAGPGTRVAVAGLGGLGHLAVKLAVALGADTSVISRSPDKAEDARRLGARELVVSTDPERLAAARERFDIVVDTVSAPHDLGAYLRLVALDGTLSHLGHLGPVTVETLDLLIGRKKLSSAGSGGRKGTAEMLAFCAEHGITADIELLPSARVNEALDRLDRGDVRHRFVLDLSDLDHSGLPDLGLSDPSDPDLRGPDRSGPQDPAAG

SEQ ID NO: 15258 - protein, 244 aa, Eucalyptus globulus
MGRGRLQLKRIENKINRQITFSKRRAGLLKKAHEISVLCDAEVALIVFSAKGKLFEYSTDSCMERILERYERYSYAEHQVLASETESIGSWTLEHAKLKARLEVLHRNYRHFMGEDLDSLSLKDLQNLEQQLESALKHIRSRKNQLMHESISVLQKKDRALQEQNNLLTKKIKEKERALAQQAQWEQQDHALDSPVVLPHYLPSLDINGSYQARHNGHDDGENLTQPRAGTLLPPWISASQLRL

SEQ ID NO: 15259 - protein, 373 aa, Saccharomyces kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAIDFFARGMVKSPIHVVGLSELPKVYELMEKGKILGRYVVDTAK

SEQ ID NO: 15260 - protein, 816 aa, Pseudomonas putida KT2440
MSQEPKARDAEVADFRAAVLNKLTYAVGKDPEHAFDHDWFEAIALAARDHMVDHWMDHTRQAYRRSQKRVYYLSLEFLIGRLLYDSLSNLGLLDVARDALEGLNVDLERIRLLEPDAALGNGGLGRLAACFMESMSTLGIAAHGYGIRYEHGLFRQAVVDGWQQEQTENWLDFGNPWEFERAEVIYPISFGGSVETVHDASGTQRQVWWPGETVRAVAYDTPVVGWRGSSVNTLRLWRARALEELHLERFNAGDHLGAVAEVARAESISRVLYPADSTEAGQELRLRQEYFFVSASLQDLLRRHLNMHKDLLNLPDAAAIQLNDTHPSIAVAELMRLLVDQHEVPWEKAWELTVGTLAYTNHTLLPEALETWPVALMERMLPRHMQIIYLINAYHIDALRAKGLHDFDVLRAVSLIEEDNGRRVRMGNLAFLGSHSVNGVSALHSKLMKSTVFSELHKLYPQRINNKTNGITFRRWLYQSNPQLTDMLVEALGPELKDDPQTLLAGLVPFADKPGFRKQFAAQRLHSKRALASIIQDRIGVTVNPEALFDVQVKRIHEYKRQLLNLMHTVALYQAIRNEPGTNWVPRVKIFAGKAAASYHQAKLIIKLANDIARVVNNDPTVRGLLKVVFLPNYNVSLAESIIPAADLSEQISTAGYEASGTSNMKFGLNGALTIGTLDGANVEMCEQVGADNMFIFGLTSQQVEARKRAGDFGANAAIAASNRLTDVLQAIRSGVFSPDDPSRYTGLIDGLVAYDRFLVCADFDDYWDAQRRVEDLWHTPQEWWRKAVLNTARMGWFSSDRTIREYATEIWKALD

SEQ ID NO: 15261 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 15262 - protein, 467 aa, Pseudomonas aeruginosa PAO1
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 15263 - protein, 300 aa, Dechloromonas sp. RCB
MALEGVESAHRDLALGQALDTPRARTRLPQTALHLLQGGLPAQGVLGYKAYTSNRSGNRFLVHLFDAASGQLNAIIEADYLGMIRTGAASGVAAKWLAKPDAKIAGVFGAGWQAEGHVRAICAALPLECVKVFSRKTERLQAFCERLTTIAGVAVIPAESAEATVRGSDLIGTVTTAAQPVFDAAWLEPGMHINAAGSNALVRQELSEASVRRCDLIAVDSVPTALAEAGDLLPLLEKGRLHSRQLLELGEVIIGRHAGRVSSEQITLFESQGMAIQDIAVALRVLAAAEERGLGSELPI

SEQ ID NO: 15264 - protein, 549 aa, Oryza sativa (japonica cultivar-group); identical to SEQ ID NO: 8346

SEQ ID NO: 15265 - protein, 251 aa, Zea mays
  unsure (1)..(251): unsure at all Xaa locations
MGSSRPAGRSLPDFRWNPQSFSRLLLPHPFSLLFFLFIHLVLTSLNQTFHDTNDLILFIMSSALNQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATXEGIKAAEILQRDHGINTNLXTLMFSLVQAIXAAEAGAYLXSPFVGXILDWVQAL

SEQ ID NO: 15266 - protein, 427 aa, Coxiella burnetii
MTELTGVSIVTYQHIKVPSEGEKITVNKAVLEAPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSASQFAKAIIKHIL

SEQ ID NO: 15267 - protein, 519 aa, Oryza sativa (japonica cultivar-group)
MAGGAMVQTVGGKTYPGKMTAFVFFTCLVASSGGLIFGYDIGISGGVTSMDSFLSEFFPSVYAQAKASKDTNQYCKFDSQLLTLFTSSLYLAALATSFVAAWVTRVFGRKWSMFCGGVTFLAGSALNGAATDVMMLILGRILLGIGVGFANQSVPLYLSEMAPANLRGMLNIGFQLMTTIGILSANLINYATSSIEGGWGWRIGLGLAGVPALIITLGALVLPDTPNSLIARGYAGDAKRVLVKIRGTDDVHDEYDDMVAASEEAASIEHPWRNILHRKYRPQLTIAILIPCFQQLTGINVIMFYAPVLFLTIGFAGDASLMSAVITGLVNMFATVVSIISVDRLGRRVLFLQGGTQMFISQVVVGTLIALQFGVAGVGEMSRSYAILLVLFICMYVAGFAWSWGPLGWLVPSEVFALEIRSAGQSIAVCVNMMLTFVIGQAFLTMLCHLKFGLFYFFAGWMLVMTTFVALFLPETKGVPIEEMNHVWSRHWFWGSYVTAHDVAGAGAGGGGNRRSHNV

SEQ ID NO: 15268 - protein, 326 aa, Aspergillus fumigatus
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENKRIRAGEALAHEYLSPYHDPTDEPEAEEKFDWSFNDADLPVDTWKIMMYSEILDFHNIDQGNDAGQVLMEGGVAQAQQNYA

SEQ ID NO: 15269 - protein, 299 aa, Methanosarcina barkeri
MDRVISIVGHTALDYIVDVERIAGKNESSPVIDYEEYPGGGAANIAVAIAKLGGKSQLISPVGTDFVSSGYEKLLTEANVDLSRLYRIEDQKISKAFIFTDKEDNQTTYFYWGASSKFKKLEPEPVDFVHLATADSVYNAKLAQIAGFVSFDPGQDLVTYSKENLELILAHTDILFANRHEIRRVSEMTGKSFSELKAMIDIIVVTYDSKGSKIYTDKNEFLIPVISVQAADPTGAGDAYRAGFLLALTRGYPLPTCGKIGSTVASFAVQARGCQTDLPTWEEMKARYEANFGRLEKEC

SEQ ID NO: 15270 - protein, 336 aa, Streptococcus dysgalactiae subsp. equisimilis
MVVKVGINGFGRIGRLAFRRIQNVEGVEVTRINDLTDPNMLAHLLKYDTTQGRFDGTVEVKEGGFEVNGNFIKVSAERDPENIDWATDGVEIVLEATGFFAKKEAAEKPLHANGAKKVVITAPGGNDVKQLFSTLTTSILDGTETVISGASCTTNCLAPMAKALHDAFGIQKGLMTTIHAYTGDQMIVDGHRGGGDLRRARAGAANIVPNSTGARKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 15271 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 15272 - protein, 497 aa, Schizosaccharomyces pombe
MSSTTDATPTPSGVNGGDSMTVNLNQFYNNGDVAWILTSTALVFIMIPGVGFFYSGLARRRSAISMLFLSMMSVAIVAFQWFFWGYSLTFSHEGGPYIGSLANFGLRQTLGRPSSGASSVPDILFCVFQGMFAAITPALAIGAAADRGRMFPCMVFMFLWTSIVYDPIAFWTWNPNGWLNKLGSYDFAGGSPVHISSGMAALAYSIVIGKRCDHGTTKYRPHNVPHVVLGTVFLWFGWFGFNGGSSAAANMRGVMAVVVTHLAASVGGIVWCVIDFAKNRHWSVVGFCEGAVAGLVAITPGSGFVPPWAAVVIGALGAVFCYAATYLKKIIRVDDALDIFAEHGVGGMVGNILTALFAADYIEALDGSGTAYTGGWITHHYIQLGYQLADTVSCAAYSFAVSCALLFVMNYIPGLSLRVSREDEVLGLDKIELGESAYYYKDSTDEPPPITTSGVQYTSPTVSDSASNEKEQEHRAQNEAQKEEEYRAESEAQAPAI

SEQ ID NO: 15273 - protein, 194 aa, Glycine max
  unsure (1)..(194): unsure at all Xaa locations
TRPLDLVKEAISRTGYNEKIKIALDVAATNFCIGKRYDLDFQSPQKSGQNFKSAEDMIELFKELCSEYPIVSIEDPFDREDWEHIKHISSXLGICQVVGDDLLMSNAKRIERAITESACNALLLKVNQVGTITEVIEVVKLAKEAHWGVVTSHRCXETIDSFIADLSVGLASGVIKAGAPCRGERLEKYNQVSF

SEQ ID NO: 15274 - protein, 488 aa, Feldmannia irregularis
  unsure (1)..(488): unsure at all Xaa locations
MPEDVQNRTRIKSERYESGVIPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLTGGLDFLKDDENINSQPFMRWKERXLYCMEGVNRAAAATGEVKGSYLNITAATIEEMYQRAEYAHAIGSVIIMIDLVIGYTAIQSLAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 15275 - protein, 813 aa, Neurospora crassa
MKLTTHPLLPLLASVLTANAFQFPDCVNGPLAKSKACDVTGTAPERAASLVDQLTIDEKLVNLVDQALGASRLGLPKYAWWSEGLHGVAGSPGVKFNTTGYPFSYATSFANAINLGASFDDDLVYEVGTAISTEARAFANFGFGGLDYWTPNVNPYKDPRWGRGAETPGEDPLHIKGWHGLTRYEFEAIVTLQDLSEYYLPPFQQCARDSKVGSIMCSYNALTIRDMASGKPDEEINLTTAQPACAKPYLMTILRDHWNWTEHNNYITSDCNAILDFLPDNHNFSQTPAEAAAAAYKAGTDTVCEVSGSPLTDVVGAYNQSLLPEAVIDTALRRLYEGLIRAGYLDHGRSSAVAGGDGGSFSSPAYDALNWEDVNTPSTQELALRSATEGIVLLKNAGSLLPLDFSGKKVALIGHWANATGTMRGPYSGIPPFYHNPLYAAQQLNLSFSYANGPVVNASDPDTWTAPALAAAEGADVVLYFGGTDTTVASEDLDRESIAWPETQMQLLSELAGLGKPLVVIQLGDQVDDSSLLNNGNVSSILWVGYPGQSGGTAVFDVLTGKKAPAGRLPVTQYPEGYVDEVPLTEMALRPFNYSSSSNLEQEVSVQGRGSLTIQPRSTPGNKTLSSPGRTYKWYSSPVLPFGYGLHYTTFNVSLSLSSSNASSSSSSPSFSIPSLLTPCTATHLDLCPFSPSANSALSVSITNTGTHTSDYVVLLFLSGEFGPKPYPLKTLVSYKRVKDIKPGETVTVKDVPVSLGAISRVDGDGNTVLYPGTYRFVVDVDGSQGVERGEEVVVELVGDEAVLDEFPQPPKE

SEQ ID NO: 15276 - protein, 231 aa, Novosphingobium aromaticivorans
MSLPPDAGRRRPMTPLISPSILSADFARLGEEVRAIDAAGADWIHVDVMDGHFVPNITIGPMVVKALRPHTTKPFDVHLMISPVDGYLQAFADAGADIITVHPEAGPHIHRTVQAIKALGKKAGVSLNPGTPAKMLDYLIDDVDLVLVMSVNPGFGGQSFISSQLRKIEAVRKMIDKSGRDIHLEVDGGVDTRTIRSCVDAGADVLVAGTATFKGGPSQYAANIAALKGLG

SEQ ID NO: 15277 - protein, 283 aa, Arabidopsis thaliana
MAPAMKIVFGLLTFVTVGMVIGSLLQLAFINRLEDSYGTGFPSLRGLRGQNTRYLRDVSRWANDKDAELLRIGNVKPEVVSWSPRIIVLHDFLSPEECEYLKAIARPRLQVSTVVDVKTGKGVKSDVRTSSGMFLTHVERSYPIIQAIEKRIAVFSQVPAENGELIQVLRYEPQQFYKPHHDYFADTFNLKRGGQRVATMLMYLTDDVEGGETYFPLAGDGDCTCGGKIMKGISVKPTKGDAVLFWSMGLDGQSDPRSIHGGCEVLSGEKWSATKWMRQKATS

SEQ ID NO: 15278 - protein, 311 aa, Staphylococcus caprae
GFGRIGRLAFRRIQDVEGLKVVAVNDLTDDEMLAHLLKYDTMQGRFTGEVEVIEGGFRVNGKEIKSFDEPDANKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLEKQDVTADQVNEAMKQASDESFGYTEDEIVSSDVVGITYGSLFDATQTRVMTVGDRQLVKVAAWYDNEMS

SEQ ID NO: 15279 - protein, 248 aa, Clostridium perfringens str. 13
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 15280 - protein, 437 aa, Petunia x hybrida
MNTNRAVLVPHRGEVGGKQKNGQADGRNNRRVLGDIGNLVTGAPVIEGKPKAQISRPATRSFCAQLLANAQAEKNKVKPLAEVVNKVPAKKKASDKPAVQEAVIVISPDEEVKKKTIEKSPLSKRKAKKTGKTLTSTLTARSKAACGLSNRPKNEIDDIDAADAANHLAVVEYVEDIYNFYKLTEDESRVNNYMEFQPELNHKMRAILVDWLIEVHRKFELMPESLYLTINILDRFLSMKTVPRKELQLVGISAMLIACKYEEIWAPEVNDFMHISDNVYTRDHILQMEKAILGKLEWYLTVPTPYVFLVRYIKAAMPSDDQEIQNMAFFFAELGLMNYTTTISYCPSMLAASAVYAARGTLNKGPLWTPTLQHHTGYSEEQLMECTKQLVSYHKGAAESKLKAIYRKFSSPDRGAVALFPPARNLLPTTTTTTTSS

SEQ ID NO: 15281 - protein, 553 aa, Oryza sativa
MILFVLATPAGFPVDQRPGWFARSPGLSAMGPTRQSHSLLLTFLLVGAAAAAAAASPEDGSPFLRLPTASDLPVPAGQLPRSAAVGLIRALNLHPRDASPSPSSRGDGDVPAGTLVERPIHLASMATGKSGGSSAEDLGHHAGYYRLPNTHDARLFYFFFESRGSKGEDDPVVIWLTGGPGCSSELALFYENGPFHIADNMSLVWNDFGWDQESNLIYVDQPTGTGFSYSSNPRDTRHDEAGVSNDLYAFLQAFFTEHPNFAKNDFYITGESYAGHYIPAFASRVYKGNKNSEGIHINLKGFAIGNGLTDPAIQYKAYTDYSLDMGLITKSQFNRINKIVPTCELAIKLCGTSGTISCLGAYVVCNLICSSIETIIGKKNYYDIRKPCVGSLCYDLSNMEKFLQLKSVRESLGVGDIQFVSCSPTVYQAMLLDWMRNLEVGIPELLENDIKVLIYAGEYDLICNWLGNSRWVNSMEWSGKEAFVSSSEEPFTVDGKEAGILKSYGPLSFLKVHDAGHMVPMDQPKVALEMLMRWTSGNLSNASSSFQRLDFTM

SEQ ID NO: 15282 - protein, 359 aa, Nitrosomonas europaea ATCC 19718
MTSPSPDQVIRQEILALSAYHVPPAKDMVKLDAMENPYRLPPFLCEEISRIAADTSINRYPDPHAAALKEVLSTTLSVPAGMEIMLGNGSDEIIQIIMLAAAKPEAKLLTIEPGFAMFKMIATFANMQYIGIPLKPDFSLDIDRMLAAIERHQPSVIFLAYPNNPSGNLFDTSALEKIIEISPGLVVIDEAYHPFAGKSFIGRLADYPNLLVMRTLSKLGLAGLRLGLLAGRPEWLSHLEKLRLPYNVNVITQLVATKIMQHYDVLQQQADAIRQTRTRLRTFLENLNGIEVFPSNANFILFRLDGASQIFRLLQQHGILVKNLDNSHPLLKNCLRVTVGTPEENDRFCNTLQDLIAGN

SEQ ID NO: 15283 - protein, 475 aa, Stenogramme interrupta
ERYESGVIPYAKMGYWDPDYVVKETDVLALFRVSPQPGVDPIEASAAVAGESSTATWTVVWTDLLTACDLYRAKAYKVDSVPNTDDQYFAYVAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYAMEGVNRSIAASGETKGHYLNVTAATMEDMYERAEFAKQLGSIIIMVDLVIGYSAIQTMAIWARKNDLILHLHRAGNSTYSRQKIHGMNFRVICKWMRMAGVDHIHAGTVVGKLEGDPLMIRGFYNTLLLPYLEVHLPTGIFFEQDWASLRKVTPVASGGIHCGQMHQLLDYLGEDVVLQFGGGTIGHPDGIQAGATANRVALETMVMARNEGRDYVAEGPQILQDAAKTCGPLQTALDLWKDITFNYTSTDTADFVETPTANI

SEQ ID NO: 15284 - protein, 313 aa, Capsicum annuum
GFGRIGRLVARVALQRDDVELVAVNDPFISTDYMTYMFKYDTVHGQWKHHELKVQDEKTLLFGEKSVRVFGIRNPEEIPWAEAGADFVVESTGVFTDMDKAAAHLKGGAKKVVISAPSKDAPMFVVGVNENEYKPDLDIVSNASCTTNCLAPLAKVINDRFGIVEGLMTTVHAMTATQKTVDGPSMKDWRGGRAASFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKKFVKLVSWYDNEWGY

SEQ ID NO: 15285 - protein, 203 aa, Triticum aestivum
  unsure (1)..(203): unsure at all Xaa locations
RVKQSRRQAIEKPIYNHVTGLLDPAELIQPPKIFVIEGLHPMYDERVRELLDFSIYLDISNEVTVAXXKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVLILVYLPFCVQRVMLTAVTWK

SEQ ID NO: 15286 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 15287 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMGAVERVTEAGILTPDVGGTANTSQVTEAVCNAIAGSNII

SEQ ID NO: 15288 - protein, 642 aa, Caulobacter crescentus CB15
MAQDAKTLDLIAVGRSSVDLYGQQVGGRLEDMGSFAKYLGGSPTNTAAGGARLGLKTGLLTRVGADHMGRFIREQLEREGVDVAGVLSDPDRLTALVILGIRDRVNFPLIFYRENCADMALEPSDVDEAWFAQAGAVLINGTHLSQPNVYETSLKAARAVKAAGGRVAFDIDYRPVLWGLTGKDAGENRFVENQQVTAKLQEVVALCDLIVGTEEEIHILGGSTDTIAALRAIRRASDALLVCKRGPEGCVAFPGAIPDALDEGVSARGFKVEVFNVLGAGDAFMAGFLRGWLRHESVETCCEWGNACGAIVVSRHGCTPAMPTWIELQAFLSERERPFRLREDAELEHIHWATTRERVYDELTVLAIDHRSQFEDLIAETGGDAERIPDFKRLALRAVQMVAGRDETRFGMLLDGRFGFEALAEAADHDYWIARPIELPKSRPLEFECSADVATELLEWPLNQVVKCLAFYHPDDESDLRERQERQLLRLADACRKTRHELLLELILPRGMSSDSRTVARAIRRLYALGIRPDWWKLEPLTDPDAWREIEIAIAENDPLCRGVVLLGLSAPEAELVASFEVVAPFPIVKGFAVGRTIFYDVARAWLSNQIDDDAAVTALAAKFKVLVDAWRRLRGSVEKAA

SEQ ID NO: 15289 - protein, 550 aa, Oryza sativa
MAASPAAGAAAATVSSFVSPSSFSSVKASKPDRLRPARRAAAVNVRCQLIYGCSQTAHCRLVGFCYSSYRWRCAIECNELDIASADAITRSLGTTRKLLILSLALWYKFTERFSFRFEAFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFIYSCNSVHTARAKIYRVSQYQYQDAEIHSITISMQKFCRRNPTVHLST

SEQ ID NO: 15290 - protein, 218 aa, Bacillus anthracis str. A2012
MMTLVILLLFLLFCVLVFWISITFSIKYVLIFTAFLFSGLLVYYSFLTLAGLVHRNSKRKDRTLEHYPSVDILIPAHNEGVVIKDTLEAMAKIEYPGKLTVYLLNDNSQDETPEIGDDFDKAYAHIRHIRVPPGEPKGKSRVLNYGLSISDGEYFCVYDADNQPEPHALRMLVEHAETTEDAVGAVGHVRTVNENRNWLTRMISLEFQIFQLLMQSGR

SEQ ID NO: 15291 - protein, 466 aa, Batrachospermum helminthosum
LCKMGYWDPDYVIKETDVLALFRITPQPGVDPVEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTADFVETPTANV

SEQ ID NO: 15292 - protein, 485 aa, Bacillus subtilis subsp. subtilis str. 168
MSFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 15293 - protein, 78 aa, Zea mays
  unsure (1)..(78): unsure at all Xaa locations
LNTMDPTKFRPSSSHDTTVTTTNAGAXGWNHHQGLTGGASGPILVEDLHLVGKXGPFRRNPFPNRGGPPPGASAKGFF

SEQ ID NO: 15294 - protein, 380 aa, Triticum aestivum
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 15295 - protein, 389 aa, Streptococcus bovis
MSTKDVKELAIEQAKKFGGKLEVCPKVPIETKADLGIAYTPGVAAVSSAIYEKKERAYELTTKKNTVAVISDGSAVLGLGNIGPEAAMPVMEGKAALFKRFAGVDSIPLVLDTQDTEEIIQTVKFLAPTFGGINLEDISAPRCFEIEQRLIDELDIPVFHDDQHGTAIVVLAALYNSLKLINKKIEDIHVVINGGGSAGLSITRKFLAAGVKHIIIVDRTGILSETDTALPPHHAEIAKLTNREHRTGDLATALEGADVFVGVSAPGVLKPEWIQQMNEQPVIFAMANPVPEIFPDEALAAGAYIVGTGRSDFPNQINNVLAFPGIFRGALDARAKKITIEMQIAAAKGIAKLIPDNELTPTNIIPDPFQEGVAKVVAESVRNAVKETN

SEQ ID NO: 15296 - protein, 106 aa, Oryza sativa
GTSNVVEAVRHVRSIMGEIRTLRDMDDDEVFAYAKRIAAPYDLVMQTKQLGRLPVVLFAAGGVATPADAALMMQLGCDGIFVGSSIFKSGDHARHARTIVQAITHH

SEQ ID NO: 15297 - protein, 190 aa, Mitthyridium sp. Wall 3744
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALS

SEQ ID NO: 15298 - protein, 492 aa, Gossypium hirsutum
MDPYKFRPSSSFDSPFWTTNSGAPVWNNNSSLTVGARGPILLEDYHLVEKLANFDRERIPERVVHARGASAKGFFEVTHDISQLTCADFLRAPGVQTPLIVRFSTVIHERGSPETLRDPRGFAVKFYTREGNFDLVGNNFPVFFIRDGMKFPDMVHALKPNPKSHIQENWRILDFFSHHPESLHMFTFLFDDIGVPQDYRHMDGSGVHTYTLINKAGKSHYVKFHWKPTCGVKSLLEDEAIRVGGANHSHATQDLYDSIAAGNYPEWKLFIQIMDPLHEDRFDFDPLDVTKTWPEDIFPLQPMGRMVLNKNIDNFFAENEQLAFCPSLIVPGIYYSDDKLLQTRIFSYSDTQRHRLGPNYLQLPANAPKCAHHNNHHEGFMNFMHRDEEVNYFPSRYDPVRHAEKHPIPSTVLSGKREKCIIGKENNFKQPGERYRSFSADRQERFINRWIDALSDPRVTHEIRSIWISYWSQADKSLGQKIASRLNVRPSI

SEQ ID NO: 15299 - protein, 492 aa, Neurospora crassa
MSTTTPQPRWRIAVGCDDAGINYKNKIKSDLSSDPRVISVIDVGVAHDSQDRSTAYPHIAAAAAKLVASGECDRALLICGTGLGVAIAANKIKGIRAVTAHDSFSVERAVLSNNAQVLCMGERVVGLELARRLAKEWLGYVFDESSASAEKVRAIHEYEGREGGREAEWVKGSTADFKKNTLEGEVKQESTTMSSASPSRERRRLVGVSTKMYFSHARTTNFITSFLDLMQHHTSTKTEQSNDNRNNLAAALASKIDIFIIPDHLSLQSAINRTANHPSQSGPTDPKILFGAQNCHWEDSGPFTGEVSPAVLAEVGCSIVELNHAERRRHFAETDAITCLKAQAVIRNGMIPLICVGEGSPGQIPALSEVAIMKAAAEVVDQVELCLEGVDPTKEVWLAYEPVWAIGAKEPAGVEHVRGVVRTIRKSEVVRGREERGGVTRILYGGSAGPGLFGQLKEVDGVDGLFLGRFAHEEGQFWKTICEVAEVEWEGR

SEQ ID NO: 15300 - protein, 381 aa, GIBBERELLA ZEAE PH-1
MLAIRALRTPASRQALRTAAPRAAIFYNRCYSTSGDRVAKYNGTKDAKGNFLVSLIEGDGIGPEIAQSVKDIFAAAKTPIAWEPVDVTPIIKDGKTAIPDAAIDNIKKNKIALKGPLATPIGKGHVSLNLTLRRTFNLFANLRPCRSVAGYETPYDNVNTVLIRENTEGEYSGIEHVVVDGVVQSIKLITREASERVLRFAFQHAESIGRKKVRVVHKATIMKLSDGLFLKVAQEVAKDFPGIEFDAELLDNSCLKMVTDPTPYNDKVLVMPNLYGDILSDMCAGLIGGLGLTPSGNIGDECSIFEAVHGSAPDIAGKNLANPTALLLSSIMMLRHMGLNEHATRIEKAIFDTLAEGKALTGDLGGKAKTNEYAAAIISRL

SEQ ID NO: 15301 - protein, 553 aa, Oryza sativa
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLMTGLAHRKLAAAAEAAGAGRLMALSLGETRVVVAAHPDVAREILHGAAFADRPVKESAYGLLFHRAIGFAPHGAYWRALRRVASTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 15302 - protein, 534 aa, Arabidopsis thaliana
MAREQLQVLNALDVAKTQWYHFTAIIIAGMGFFTDAYDLFCISLVTKLLGRIYYHVEGAQKPGTLPPNVAAAVNGVAFCGTLAGQLFFGWLGDKLGRKKVYGMTLMVMVLCSIASGLSFGHEPKAVMATLCFFRFWLGFGIGGDYPLSATIMSEYANKKTRGAFVSAVFAMQGFGIMAGGIFAIIISSAFEAKFPSPAYADDALGSTIPQADLVWRIILMAGAIPAAMTYYSRSKMPETARYTALVAKDAKQAASDMSKVLQVEIEPEQQKLEEISKEKSKAFGLFSKEFMSRHGLHLLGTTSTWFLLDIAFYSQNLFQKDIFSAIGWIPPAQSMNAIQEVFKIARAQTLIALCSTVPGYWFTVAFIDVIGRFAIQMMGFFFMTVFMFALAIPYNHWTHKENRIGFVIMYSLTFFFANFGPNATTFVVPAEIFPARFRSTCHGISAASGKLGAMVGAFGFLYLAQNPDKDKTDAGYPPGIGVRNSLIVLGVVNFLGILFTFLVPESKGKSLEEMSGENEDNENSNNDSRTVPIV

SEQ ID NO: 15303 - protein, 317 aa, Eremothecium gossypii
MSEERGMKEQTISEMAQEMAHTTSEGLKKRIRKLYTFDELPAWQKDNELILSGYVRETNSVKECLRAMTYFNNESINIYTHLIPGVAYLVLFLIFADLVLAQLLPGLDAGEHRMLRFYLLGAFTCLACSSCFHCLKQHSEPHSRLWSKVDYLGILAQITCSTISLLYYGYHSYPSHFVFFSTLTVALCSACAVLVLNDSFNTVAFRPLRAFLFMAFGLSGVIPVLAGSYQFGFAEWAARIQLKYVLYEAVFYITGALVYGFRIPERFAPGKFDMVGHSHQIFHLLVVLGTLCHFRAVTGSYIFICTGKHYSSLLMFI

SEQ ID NO: 15304 - protein, 351 aa, Triticum aestivum
  unsure (1)..(351): unsure at all Xaa locations
MASDRLAALKAFDETKAGVKGLVDAXGVKAVPDIFRHPPDPLSPCTKVAAIPVVDLSGPRSEVVGAVREAAPDXGFFQLVNHGVPGGXCRGCLAAVRRFNEEPAEAKAPYYTRDAGRRVRYNCNADLFRTLLGKWRDTIYMDDVDRLAPGEEEEVLPPACRGVAPKYTAQIRMLGRALFELLSEALGVRRGYLEEEAGCLGTLSVAGHYYPACPEPHLTLGAVRHNDPGFLTVLLQDGVGGLQVLTDVEDGEGNVSAAWADVPAVPGALVVNVGDFLQLVSNDRFRSVAHRVVANSVGPRMSVACFFRAKGATVCAPVVMDGGGLPRYRTVTAEELLRSSGKQNGLRDVRL

SEQ ID NO: 15305 - protein, 511 aa, Agrobacterium tumefaciens str. C58 (Cereon)
MRREPIMHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 15306 - protein, 231 aa, Glycine max
LQCGLTSRNLVSNGWRTWSAIGWIPPAKEMNAIHEVYKIARAQTLIALCSTVPGYWFTVALIDYMGRFAIQLMGFFFMTVFMFALAIPYNHWKNHNNIGFVVMYSFTFFFSNFGPNATTFVVPAEIFPARLRSTCHGISAAAGKAGAIVGAFGFLYAAQSTNPNKVDHGYPTGIGVKNSLIVLGVINFFGMVFTLLVPESKGKSLEELSGENEDDGAEAIEMAGSARTVPV

SEQ ID NO: 15307 - protein, 120 aa, Zea mays
  unsure (1)..(120): unsure at all Xaa locations
KEHALENGPIILEMDTYRYXGHSMSDPGSTYRTRDEIAGIRQERDPIERVRKLMLVHEFATAQELKDMEKEIRKQVDAAIAKAKECPLPDPSELFTNVYVNDCGLESFGVDRKEVRTVLP

SEQ ID NO: 15308 - protein, 314 aa, Nostoc sp.
NGFGRIGRNFARCWLGRQNSNIDLIAVNGTSDPKTNAHLLKYDSMLGKLKDVDITADDNSIIVNGKTIKCVSDRNPENLPWREWGIDLIIESTGVFTSKEGALKHVNAGAKKVLITGPGKNEDGTFVIGVNHHDYDHNVDHIISLASCTTNCLAPIANELNEKFGIIKGTMTTTHSYTGDQRLLDASHRDLRRARAAAINIVPTSTGAAKAVALVIPELKGKLNGVALRVPTPNVSMVDFVVQVEKRTITEEVNQALKDASEGSLKGILDYSELELVSSDYQGTDASSIVDASLTLVMGNDLVKVMAWYDNEWG

SEQ ID NO: 15309 - protein, 152 aa, Oryza sativa (japonica cultivar-group)
WGGEGAGQVLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 15310 - protein, 235 aa, Nostoc punctiforme
MTQNLSQKPIVISPSILSADFSRLGDEIRAVDAAGADWIHVDVMDGRFVPNITIGPLIVEAIRPVTTKPLDVHLMIVEPEKYVEGFAKAGADIISVHCEHNASPHLHRTLGQIKELGKKAGVVLNPGSPLELIEYVLDLCDLVLIMSVNPGFGGQSFIPGVLPKIRKLRQMCDERGLDPWIEVDGGLKANNTWQVLEAGANAIVAGSAVFNAKDYAEAITSIRNSKRPTPELAKV

SEQ ID NO: 15311 - protein, 364 aa, Magnetococcus sp. MC-1
MQCFAIACLVSVLWLAGGYSLAFEHGGPLNGVIGSLQKAFFAGVAHNTVKGSLPEGVFAAFQMTFAIITPALVIGGFAERIRFAVILPFTALWLLLVYIPVCHWVWGGGWMQAAGVMDFAGGVVVHITAGVAALVAALVLGPRNGFQKTVMFPHNLTMTYAGAAMLWVGWFGFNGGSALTADGSAGWAILATHMGAAAGSLAWMGMEWMRHGKPSVLGIVTGMVAGLGTVTPASGYISPFGGFAIGLIAGVVCYLATMMVKQRWKIDDSLDVFPVHGVGGMIGTLMTALFAAPLFGGHGLASNAQILPQLATQGVAVGVTALYTAVVTWLIFKGLAQVMQLRVSRDQETEGLDLVDHDERGYNL

SEQ ID NO: 15312 - protein, 514 aa, Aspergillus niger
MRLPKIKMPRKRPQDELNGDVLQQEAQATGPNGQKSEEGIVDTPIPLLTWRSFLMGIFVSMGGFLFGYDTGQISGFLEMPNFLQRYGQQQADGTYYFSNARSGLIVALLSIGTLIGALIAAPIADRVGRKWSISGWSAMVCVGITIQISSPFGKWYQVAMGRWVAGLGVGALSLLVPMYQAETGPRHIRGSLVSTYQLFITLGIFVANCINFGTEARNDTGSWRIPMGITYIWAMILGFGIALFPESARYDYRHGREAKAARTLSRISSWKEQERGEITWSHLFHAPRMKYRVAVGVALQALQQLTGANYFFYYGTTIFRGAGISNSYVTQMILGGVNFGTTFLGLYLIENYGRRRSLITGALWMFVCFMVFASVGHFSLDHENPERTHTAGVVMVVFACLFILGFASTWGPMVWTIIAELYPSEFRARAMSLATASNWLWNFLLAFFTPFITSAIDFRLGYVFAGCLFLAAGLVYVAVIEGRGRTLEEIDTMYVMKVPPWKELQVCISGHRSI

SEQ ID NO: 15313 - protein, 391 aa, Synechocystis sp. PCC 6803
MQFADRLNAFGGNVFADMDLAKAQARAQGQTIIDLSLGSSDLPTPAPILATIAKALEDPSTHGYLLHQGTLPLRQAIAVWYEKRFGLAVDAETEVLPLIGSQEGTAHLPLAVLNPGDVALLMDPGYPSHMGGVYLAGGEIYPMALRSENQFLPVFTAIPNSVLAKAKMTVLSYPHNPTTAIASLEFFQTAVQFCRDHDLVLVHDFPYMDLVFDGIAMPPSVLQADRQKSCAIEFFTFSKSYNMGGFRIGFAIGNIQLISALKKIKAVVDFNQYAGILQGAIAALESPPETVQQTVQIFAQRRATLIDALAKIGWAVPLPTATMYVWAPLPESWLGNSLEFCQKLVAKTGVALSPGSGFGAGGEGYVRFALVQEPDILATAAKKIGQFLDQN

SEQ ID NO: 15314 - protein, 470 aa, Oryza sativa; identical to SEQ ID NO: 8584

SEQ ID NO: 15315 - protein, 267 aa, Desulfovibrio desulfuricans G20
MLDDLLSHGRRYAFVSNSDNLGAVLDMRILGYMAGNELPFIMEVAPRTASDKKGGHLAQHRDGGLILRELAQCPPDETDAFQDIRRYGLFNTNNLWVDLHALKKRIEKEGLLRLPVILNPKTVNPRDKSSEPVWQVETAMGAGISMFTGAQAVVVNRDRFIPVKKCSDLLAVMSDCFALNQGTVSFSPECRYPTPQVTLDDRYYDHYDKLLQRIPYGPPSLKECSSLTIKGDVTFGRNVVIRGDTTITTGGTAHIPDNTELEGEVIL

SEQ ID NO: 15316 - protein, 103 aa, Zea mays
RVRYTCNALVLKANQVGTVTEAIEVVKQAKDAHWGVMVSHRSGDTEDSFIADLAVGASAGQIKAGAPCRGECLTNYNQLLRIEGELGSEGVYAGENWRTVNTS

SEQ ID NO: 15317 - protein, 123 aa, Triticum aestivum
  unsure (1)..(123): unsure at all Xaa locations
MAPTVMASSATSVAPFQGLKSTAGLPVSRRSNGASLGSVSNGGRIRCMQVLAHRGHQEFETLSYLPPLSTEALLKXVDYLIRSKWVPCLQXNKVXFIFREXNASPGXYNGRIGMWKLLMFGVH

SEQ ID NO: 15318 - protein, 72 aa, Salmonella enterica
SEQALYYIGGVIKHAKAINALANPTTNSYKRLVPGYEAPVMLAYSARNRSASIRIPVVASPKARRIEVRFPD

SEQ ID NO: 15319 - protein, 739 aa, Glycine max; identical to SEQ ID NO: 1328

SEQ ID NO: 15320 - protein, 413 aa, Nicotiana tabacum
MGVIELCNTSSICIGRAKPSCCSIERNQRRRIICMASSVPVQEESQQKQRVTGDAFIRPHLLKLSPYQPILPFEVLSTRLGRKPEDIVKLDANENPYGPPPEVIEALGAMKFPYIYPDPESRTLRAALAEDSGLESEYILAGCGADELIDLIMRCVLDPGDMIVDCPPTFTMYEFDAAVNGAHVIKVPRNPDFSLDVERIAEVVEHEKPKCIFLTSPNNPDGSIVDDETLLKILDLPILVILDEAYVEFSGMESKMKWVKKHENLIVLRTFSKRAGLAGLRVGYGAFPKSIIEFLWRAKQPYNVSVAAEVAACAALKNPTYLENVKVALVQERERLFNLLKEVPFLDPYPSYSNFILCKVTSGMDAKKLKEDLATMGVMIRHYNSKELKGYVRVSVGKPEHTEALMKCLKHFY

SEQ ID NO: 15321 - protein, 385 aa, Phaeodactylum tricornutum
MKVATTLTLAFICCASAFGLNGQTTSVMKKVGFGAGSKPMVQAIDVQGNRLGSNMQPLKSAVANEDAPRGGATKSPVDIGLLLYFGLWYLGNYYYNITNKLALNAAGGKVGFPMTISSLQLGVGSIYALFLWLAPDARSRPKISMDDIVKMLPVALCFMGAHSASVFAMGMGAVQFAQIVKASEPAFAAVLSQFVYGKKSRRHKWLCLPIVIGGVILASVKELDFAWSALIAACIANMFAAVRGNENKKLMETPGLKDRIGTVGNQFAITTVLGFILSLPVLFLREGSRFGEFVQLAKTTPAIWMNLVASGLWFYGYNECATMTLKKTGAVTQSVANTAKRVIVIVGVALVLGESLSPIKLIGCSIGIGGVFLYSIIDNLVKPKK

SEQ ID NO: 15322 - protein, 525 aa, Thermobifida fusca
METVTHPTATRSLPLDDALVQRLTRHVVSSTGRTVVTTAPFTGEPLATLPQSSASDVTEAFRRARAAQREWAQRSPRQRIAPFLRFSDLLLDRQTEILDILQWETGKARKNAFEEVCDAALGTLHYARHAPRLLRRRRAPGAIPLATRTRVNYQPKGVVSVITPWNYPLTLPVADAVPALLAGNAVVAKPDTQTALSALWAIDLLVEAGLPRDLWLVVLGEPAEIGDPLVDEADYVAFTGSSATGARIAQRAASRLIGCSAELGGKNPMIVCADADLDRTVHGAVAACFSNSGQLCISMERLYVHDSIYDAFVEKFVAETKNLRLGADLDYSADLGSLTSQRQFDRVVAHVEDARSKGATVLAGGRPRPDVGPLFYEPTVLTGVDESMTLCAEETFGPVVSLYRFTTEDEAIERANHTPYGLNASVWTRDVARGRRIAERLKAGTVNINEGYGAAFASYGAPMGGMKRSGLGRRHGVEGILRYTEAQTVSSQHVVGLSGPPGMSAETLSRVMTTGIRLMRALRIR

SEQ ID NO: 15323 - protein, 208 aa, GIBBERELLA ZEAE PH-1
MSDSGIQDGKPMVENQHEIDHDREHDEEQEQGTEMSATEEEEITAMKRRVAEMEEEAKKLREMQATLEQQSAELADDKESIDARSIFVGNVDYSASPEDIQGHFQSCGSINRVTILLDKFTGQPKGYAYVEFTEPSLVAQALVLNESMFKGRSIKVTPKRTNVPGMSRGRGRGGFRGGRGSFQGRGGFPRGGGYRGGYRGRGRGFAPY

SEQ ID NO: 15324 - protein, 399 aa, Glycine max
MDRVFSVDDISDHFWQPPIPVSAAQTSSQMSRSASEWAFQRFLQEASASAPSPPSSSSAADVVFVEIEDQPKPAPPPPSNGAVLPNAPGPVPLDSDEYQAFLKSKLNLACAAVAMTRGSLAKSQDPSPFSEGSIPSENDPSKLQDKDTNVPVGIPSIPAMQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRTKVKMAEETVKRITGLNPLLHAMSDISSLGLPSFDGRSPSDTSADAAVPVQDDPHHHFYQPTSTNPIPSHDPIVNNGLGGISSIENVQQNAAVVLGGNKMGQTASLQRVASLEHLQERIRGGPPSNGEQ

SEQ ID NO: 15325 - protein, 507 aa, Staphylococcus aureus subsp. aureus Mu50
MTMSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 15326 - protein, 426 aa, Triticum aestivum
VIPTRKDMEGKIESMRVLDNNPQKPVVRMANLCVVAGHTVNGVAELHSNILKQELFADYVSIWPNKFQNKTNGITPRRWLRFCNPELSEIVTKWLKTDQWTSNLDLLTGLRKFADDEKLHAEWAAAKLASKKRLAKHVLDVTGVTIDPNNLFDIQIKRIHEYKRQLLNILGAVYRYKKLKEMSAEERKKVTPRTVMVGGKAFATYTNAKRIVKLVNDVGAVVNNDADVNQYLKVVFIPNYNVSVAEVLIPGSELSQHISTAGMEASGTSNMKFSLNGCVIIGTLDGANVEIREEVGQDNFFLFGAKADQIAGLRKEREDGLFKPDPRFEEAKQFIRSGAFGTYDYTPLLDSLEGNTGFGRGDYFLVGYDFPSYIDAQARVDEAYKDKKKWIKMSILNTAGSGKFSSDRTIDQYAKEIWGISACPVP

SEQ ID NO: 15327 - protein, 349 aa, Oryza sativa
  unsure (1)..(349): unsure at all Xaa locations
IPSSSFNSNQSAALNLSLLAPPSFSGSFSNSAIPSTAQSPNCFLSISANSSGGPTSNMFAVGPYANEPQLVSPPVFSTYTTEPSTAPLTPPPELAHATTPSSPDVPYARFLLSSMDLKTAGKDHNMPYLSTAYSGGSGLQASYPLYPESPSSSLISPASATPRTGLSSPIPEQEVPTAHWKTSRSACDTXYSRASPIPEQEVPTAQWKTSRSACDTPYSRNSPSNIFGLDSAASRNYMLDNNFFRPAASAQFYLDQAQQSFPYNNGGRISVSRDKQDAEEVEAYRASFGFSADEIVTTQAYVEIPDALDEGFSISPFGNNAPATEVDXPLFNXKVTTSPKKSADQLSND

SEQ ID NO: 15328 - protein, 218 aa, Bacteroides thetaiotaomicron VPI-5482
MKFFIDTANLEQIQEAYDLGVLDGVTTNPSLMAKEGIKGTENQREHYIKICKIVNADVSAEVIATDYEGMIREGEELAALNPHIVVKVPCIADGIKAIKYFTEKGIRTNCTLVFSVGQALLAAKAGATYVSPFVGRLDDICEDGVGLVGDIVRMYRTYDYKTQVLAASIRNTKHIIECVEVGADVATCPLSAIKGLLNHPLTDSGLKKFLEDYKKVNG

SEQ ID NO: 15329 - protein, 362 aa, Corynebacterium efficiens YS-314
MCAWPTLRRATILARMTIPVKALQKTGPDAPFQITTIQRRSPRADDVVIDIKAAGICHSDIHTVRNEWGEANFPLTVGHEIAGVVSAVGSEVTDWKVGDRVGVGCLVDSCGTCEMCQQGFENHCLNGAVGTYNSVDVDGTITQGGYAEKIVVSERFVCRIPDALDFDVAAPLLCAGITTFSPIVQWNVKEGDKVAVMGLGGLGHMGVQIAAAKGAEVTVLSRSLKKAEVAKSLGAVRTLATSDESFFNDYRGEFDFILNTISANINLGAYLGLLKPRGVMAVVGLPPEKQPLSFGSLIGGSKVLTGSNIGGIPETQEMLDFCAEHGLGARIEKISVHEVDEAYDRVVAGDVQFRFVIDTSTF

SEQ ID NO: 15330 - protein, 330 aa, Nostoc punctiforme
MLRAGLDNPNIEFVGINDLVPPDNLAYLLKYDSTHGQLKHKVEAKEDGILIDGHFIPCVSMRNPAELPWGKLGADYVVEATGLFTDYEGAANHLKAGAKRVVISAPTKDPDRVTTLLMGVNHHLFDPGKDIIVSNASCTTNCLAPIAKVINDNFGLTEGLMTTVHAMTATQPTVDGPSKKDWRGGRGASQNIIPSSTGAAKAVALVLPELKGRLTGMALRVPTPDVSVVDLTFKTAKATSYKEICAAMKEAAAGSLAGILGYTDEEVVSTDFQGDTHSSIFDAGAGIELNSNFFKVIAWYDNEWGYSNRVIDLMLSISQKEKLASTVAVV

SEQ ID NO: 15331 - protein, 281 aa, Eremothecium gossypii
MGREQYKVKAGLAQMLKGGVIMDVVTPEQAIIAEKAGACAVMALERIPADMRKSGQVCRMSDPKMIREIMESVSIPVMAKVRIGHKVEAQILEALQVDYIDESEVLTPADWANHIEKHDFKVPFVCGAKNLGEALRRIEEGAAFIRSKGEAGTGDVSEAVKHINLIYQEIQWCKENLKTDEQFEAHAKELRVPVELLKETVAAGKLPVVTFAAGGVATPADAALLMQLGCEGIFVGSGIFKSSNPEKLARAIVQATTHYMSPEKLLEVSSDLGEMMAGYDR

SEQ ID NO: 15332 - protein, 407 aa, GIBBERELLA ZEAE PH-1
MAPSAVETQDVNLTAAAIHKKEVAQPTTTTQAPLDASKLTYTYTQNPRSVPDEANAHSGDETIATDHMVLAAWKQSTGWAAPELKPYGPLSLMPTASVLHYATECFEGLKVYRGYDGKLRIFRPDRNAARLRMSSTRISLPSFEPSEIEKLMISLLSVDGTKWLPADRAGSFLYIRPTVIGTAPQLGVSAPKEALLYIIVTFMPRMDAPPGGMRLHTSPDDMVRAWVGGFGYAKVGANYGPSLLATADARTRGFHQILWLYGSQGECTEAGASNFFVVWKRKDGKKEIITAPLDDKLILDGVTRRSCLELIRERLGDEYEITERKYTISEVMEADAEGRLLESFAAGTAYFICPISQIHHRGKDINIPMGAEGEAGEVTSKVKGWLGDIMYGRTEHPWGVVIPEKKQ

SEQ ID NO: 15333 - protein, 485 aa, Burkholderia cepacia
MLKKSTTSSTANMCRVSVGSRSSSPLNNAVIAKVHEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAVRRPVGVVGVICPWNLPLLLMTWKVGPALACGNTVVVKPSEETPQTAALLGEVMNTAGVPPGVYNVVHGFGPNSTGEFLTSHPDVNAITFTGETGTGEAIMKAAADGARPVSLELGGKNAAIVFADCDLDKAIEGTLRSCFANCGQVCLGTERVYVERPIFDRFVSRLKKGAEGMQLGRPEDLATGMGPLISQEHREKVLSYYKKAVEAGATVVTGGGVPEMPEALKGGAWVQPTIWTGLGDDSVVAREEIFGPCALVMPFDSEEEVIRRANDNDYGLARRIWTTNLSRAHRVAGAIEVGIAWVNSWFLRDLRTAFGGSKQSGIGREGGVHSLEFYTELKNVCIKL

SEQ ID NO: 15334 - protein, 529 aa, Oryza sativa; identical to SEQ ID NO: 7292

SEQ ID NO: 15335 - protein, 335 aa, Zea mays
  unsure (1)..(335): unsure at all Xaa locations
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDGTLRGELMMCFLFFTIGSFKRRXNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPVPRIKSEMLDGEDVPLKARVSGVPAVDLEDGEMKS

SEQ ID NO: 15336 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 15337 - protein, 497 aa, Zea mays
  unsure (1)..(497): unsure at all Xaa locations
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPXDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 15338 - protein, 540 aa, Petunia x hybrida
MAFDFGTLLGNVDRLSTSDHQSVVSINLFVALICACIVIGHLLEENRWMNESITALVIGSCTGIVILLISGGKNSHILVFSEDLFFIYLLPPIIFNAGFQVKKKSFFRNFSTIMLFGALGTLISFIIISLGAIGIFKKMNIGSLEIGDYLAIGAIFSATDSVCTLQVLNQDETPLLYSLVFGEGVVNDATSVVLFNAIQNFDLSHIDTGKAMELVGNFLYLFASSTALGVAAGLLSAYIIKKLYFGRHSTDREVAIMILMAYLSYMLAELFYLSAILTVFFSGIVMSHYTWHNVTESSRVTTKHTFATLSFIAEIFIFLYVGMDALDIEKWKFVSDSPGISVQVSSILLGLVLVGRAAFVFPLSFLSNLTKKTPEAKISFNQQVTIWWAGLMRGAVSMALAYNQFTRGGHTQLRANAIMITSTITVVLFSTVVFGLMTKPLIRILLPSHKHLSRMISSEPTTPKSFIVPLLDSTQDSEADLERHVPRPHSLRMLLSTPSHTVHYYWRKFDNAFMRPVFGGRGFVPFAPGSPTDPVGGNLQ

SEQ ID NO: 15339 - protein, 510 aa, Petunia x hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 15340 - protein, 178 aa, Glycine max
  unsure (1)..(178): unsure at all Xaa locations
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 15341 - protein, 460 aa, Clostridium perfringens str. 13
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGAYLLSLLDILGIKLPKTFTAIPSEGGIVNLPAMISILFIVFVISLGTKESKKVNDIMVFIKIVVIALFIGVGAFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEETWKIFIVVLVLLITSYLVYGRKHSLINKNNDN

SEQ ID NO: 15342 - protein, 368 aa, Glycine max
MTTEGGPNTSLLVWFFPFIVFLLKVLKLFCYVFARGRERAMALEAVVFPQSQDPFGGSGYGSVNNKDFYNCTLLAATSPNSWGDYEQHININKEEEQGGASISTFQPESNYPYGNWTSSSSSMLPHFNNELQETTTTDPSNTLDSLNTRPKRRRAKSRKNKEEIENQRMTHIAVERNRRKQMNEYLSVLRSLMPDSYIQRGDQASIIGGAINFVKELEQRMHFLGAQKEGEGKSEAGGATNMPFSEFFTFPQYSTSGGGGCSDNSAAVGEDVGEVKCGIADIEVTMVESHANLKIRSKKRPKQLLKLVSGLHTMRLTILHLNVTTTGEVVLYSLSVKVEDDCKLGSVDDIAAAVYQMLDKIQQEAMLN

SEQ ID NO: 15343 - protein, 407 aa, Schizosaccharomyces pombe
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKVHISPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 15344 - protein, 526 aa, Candida albicans
MSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRRWTLILSTLIVFNLGVLLQTVATEKKLLIAGRAIAGTGVGLISSVIPNYISETTPKWARGAVTASYQWMITWGLLIAACANKGSQGRKDSGSYRIPIGIQFLWALILGIGFLFLPETPRYWVSKSEETKAKDSLRRIRNLPVDHPDLVSEYDDIKANFDFESKYATSSWTQVFKNVNKQHHRLFTGVAIQALQQLTGINFIFYYGTQFFKRSGIEDPFLIQLATNIVNVGMTVPGIILVETWGRRPLLMAGSVVMAVSQLIVAIVGVAASSHAANQCLVAFSCIFIAGFAATWGPLCWAICGESFALNVRSKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 15345 - protein, 283 aa, Bacteroides thetaiotaomicron VPI-5482
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 15346 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFFKVGKKTECFFRFFTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQVAFTPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 15347 - protein, 221 aa, Zea mays
MGNPEKLMAQIFDLKFTSKSLQRQARKCEKEEKEQKLKVKKAIEKGNVDGARIYAENAIRKRTEHMNYLRLASRLDAVVARLDTQAKMQAIGKSMGNIVKSLDSSLATGNLQKMSETMDSFERQFVNMEVQAEFMEGAMAGSTSLSTPETEVNSLMQQVADDYGLEVSVGLPQAAAHAIPAAKEKEKVDEDDLTRRLAELKPAAERRLSLHFRYGSCNVHS

SEQ ID NO: 15348 - protein, 331 aa, Kluyveromyces marxianus
MVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVAKN

SEQ ID NO: 15349 - protein, 472 aa, Trichodesmium erythraeum IMS101
MYEKITPPTTGSKVTFSNGQPIVPDDPIIPFIRGDGTGLDLWPASQKVFDAAIATAYGDKRKINWFKIYAGDEACDKYGTFQYLPEDTLNAIKEYGIAIKGPLTTPIGGGIRSLNVALRQINDLYACVRPCRYYTGTPSPHKTPEKLDVIIYRENTEDIYLGIEWREGTDIASKLIDILNKDLIPATLEHGKKQIRFDSGIGIKPVSKTGSQRLVKRAIQNALRLPKSKQMVTLVHKGNIMKYTEGAFRDWGYELATTEFRQECVTERESWILSNKEENLNISSEENSRKIDPGYDALTPEKQAEICQEVEDVLAAIWDSHGHGKWKEKIMVNDRIADSIFQQIQTRPEEYSILATMNLNGDYLSDAAAAIVGGLGMGPGANIGDKCAIFEATHGTAPKHAGLDRVNPGSLILSGVMMLEYIGWQEAADLIKKGIEISISNGEVTYDLARLMEPSVPALKCSEFADAIIKHF

SEQ ID NO: 15350 - protein, 348 aa, Xylella fastidiosa 9a5c
MNASGYAAYSPTEPLRPFSFERRAPRPDDVAIEILYCGVCHTDLHFARGHKGGTFPLVPGHEIVGRVTGVGSEVTRVQVGQVVGVGCMVDSCGHCAACDGGHEQHCLQGMTPTYNGTDRHDGSTTYGGYSDRIVVPEHFVLNVPDQLDLAGVAPLLCAGITTWSPLRRWKVGPGSRVAVVGLGGLGHMALKLAKAMGAEVTLFSRSPGKEADARRLGADHVVISTDAEQMAAIKGKYDLIVDTVPYDHDLNPYVPTLSFHGTLVLVGYMGPLDDKLNTLPVVFGGRAVAGSFIGGIPETQAMLDFCGEHGIVSDVELIRMQEIEDAYERMLRSDVKYRFVIDMASLKA

SEQ ID NO: 15351 - protein, 434 aa, Yersinia pestis KIM
MTRILQSINKIALKERLMESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 15352 - protein, 156 aa, Zea mays
  unsure (1)..(156): unsure at all Xaa locations
KKKPPPRPALPFTARPWRPGGRHQKSAFNAPXWTTNSGAHGGNNDSSLTGGARGPILLEDYHLGEKLPNWERDRIPYRVVHPRGPSAKGFFQGTHDITHLTCADFLRAPGVQTPVIVRFWRGIHERRIPQTLRDPRGFTTKFYTRHGNCDLTTNNF

SEQ ID NO: 15353 - protein, 468 aa, Corynebacterium glutamicum ATCC 13032
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 15354 - protein, 282 aa, Escherichia coli
ALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 15355 - protein, 347 aa, Guillardia theta
MKLLLYDDLKTLFNYKIKKKNNTIVHFLYLLYENVHESLNINNTRNFLWCFMIKFSVEIKKRIKFDYKSCHINFYSFFDNLLEAGNVLNFEKLILNILFNFRKIQFLYIPFTNVMKVQTEINKNMRKILIDWIIDVHHKFKLLSKTLFLTINIIDRFLCLKKIGKQKLQLLGITSMFIASKYEEIYAPEIRDFIYICDNAYSKEDIIKMEQLICFVLRFKFNLPSPQSFLSLWMKILCLKLDSIFFSNKCLELCLIEINTLRYNFEIISLSCIFLSLKFSGNISLKILMNIFRIDSKKNFSLVKSCGLIGSLLLLYQSSYCGQNHLHFKYSSNKHKEFMSRRFHIYF

SEQ ID NO: 15356 - protein, 492 aa, Triticum aestivum; identical to SEQ ID NO: 5519

SEQ ID NO: 15357 - protein, 192 aa, Triticum aestivum
  unsure (1)..(192): unsure at all Xaa locations
MAPTVMASSATSVAPFQGLKSTAGLPVSRRSNGASLGSVSNGGRIRCMQVWPIEGIKKFETLSYLPPLSTXEALLKQVDYLIRSKWVPCLEFSKVGFIFREHNASPGXYYDGRYWTMWKLPMFGCTDATQVINEVEEVKKEYPDAYVRIIGFDNMRXVQCVSXIXFKPPGCEESGKXTGSHGPHIKPLRFQL

SEQ ID NO: 15358 - protein, 811 aa, Oryza sativa; identical to SEQ ID NO: 9115

SEQ ID NO: 15359 - protein, 592 aa, Burkholderia fungorum
MTSVLHRDAFERPCVAKNDSCPADQANGARMNRARLHAFRTLASNGTLLAECFAGWRVAAMRIRHVTSRQCRLSPSPPGQSLEASHMNHADMQFLDVEFPYARQYGNFIGGEWVPPVRGEYFDNVSPITGEPFTSIPRSTEEDIELALDAAHRARKAWADTAPALRANVLNRIADRMEQNLSRIAFSESIDNGKPIRETLAADIPLAIDHFRYFASCIRAQEGTLSEIDHDTVAYHFHEPLGVVGQIIPWNFPILMAVWKLAPALAAGNCVVLKPAEQTPASILVLIELIQDLLPPGVLNVVNGFGLEAGKPLASSKRIAKIAFTGETSTGRLIMQYASQNIIPVTLELGGKSPNIFFADVVDQDDGYFDKALEGFAMFALNQGEVCTCPSRVLIDEKIYDRFMERALKRVAAIAQGHPLDPRTMIGAQASQEQLEKILSYVDLGKQEGAECLIGGERNTLGGELSKGYYVKPTVFRGNNKMRIFQEEIFGPVVSVTTFRTEEEALEIANDSLYGLGAGVWTRDGTRAYRFGRQIQAGRVWTNCYHAYPAHAAFGGYKQSGIGRETHKMMLDHYQQTKNLLVSYSEQPLGFF

SEQ ID NO: 15360 - protein, 175 aa, Triticum aestivum; identical to SEQ ID NO: 6398

SEQ ID NO: 15361 - protein, 638 aa, Nostoc punctiforme
MQTQDRVKVNQVAEAIAASQQYLLSIQNPAGYWWAELESNVTITAETVLLHKIWGTDQTRPLHKVEAYLRQEQRQHGGWELFYGDGGELSTSVEAYMALRLLGVPATDPAMIRAQAFILQRGGISKTRIFTKLHLALIGCYNWRGIPSLPPWIMLLPKAFPVNIYEMSSWARSSTVPLLVVCDRKPVFITDPTINLDELYAEGIDRVRWELPQSGDWTDLFLTLDQGFKWAESLNLVPFREEGIKAAEKWILERQEATGDWGGIIPAMLNSMLALRCLDYDRSDPIVERGLQAIDNFAIETDNSYRVQPCVSPVWDTAWVMRALVESGFVPDHPAVVKAGEWLLQKQILDYGDWAVKNRQGKPGAWAFEFENRFYPDVDDSAVVVMALHLAKLPNEKIKQAAIARAVNWIASMQCKPGGWAAFDLDNDQDWLNSIPYGDLKAMIDPNTADVTARVVEMLGACDLSIDSDNLERSLTYLLREQETEGCWFGRWGVNYIYGTSGVLSALALIDPQRHKLSIERGAAWLLGCQNLDGGWGETCRSYDDPSLKGKGDSTASQTAWALIGLLAAGEATGKLAVKAIEQGIGYLMATQQPDGTWFEANFTGTGFPCYFYLKYHLYQQYFPLIALGRYQAAIKES

SEQ ID NO: 15362 - protein, 208 aa, Zea mays
  unsure (1)..(208): unsure at all Xaa locations
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSALATGNLQKMSETMDNFERQFVNMEVQAEFMEGAMAGSTSLSTPETEVNSLMQQVADDYGLEGLPSGLXPQAAAHAIPGRQGIREKVDEDDLXSRRLAELKARG

SEQ ID NO: 15363 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 15364 - protein, 461 aa, Mesorhizobium sp. JS5A15
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDRAQEMGSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 15365 - protein, 158 aa, Glycine max
MDIRLMDLDSPLFNTLHRIMDLTEDAEKNLNAPTRTYVRDAKAMAATPADVKEYPNYYVFVIDMPGLKSGDIKVQVEDDNVLLISGERKREEDKEKEGAKYLRMERRVGKFMRKFTLPENANTDAISAVCQDGVLTVTVNKLPPPQPKKPKTIEVKIA

SEQ ID NO: 15366 - protein, 570 aa, Lipomyces spencermartinsiae
MCGSTLSASLYVYNDDYDKIVTLYYLTSSGTTGSTLALILPVWSNNWELWTLSAIAAGAVEITGASYVDSDTSVTYTTSLDLPLTTTSASVPTGTAANWRGRSIYQVVTDRFARTDGSITYSCDVTDRVYCGGSYRGIINMLDYIQGMGFTAIWISPIVENIPDDTGYGYAYHGYWMKDIFALNTNFGGADDLIALATELHNRGMYLMVDIVVNHFAFSGNHADVDYSEYFPYSSQDYFHSFCWITDYSNQTNVEECWLGDDSVPLVDVNTQLDTVKSEYQSWVKQLIANYSIDGLRIDTVKHVQMDFWAPFQEAAGIYTVGEVFDGDPSYTCPYQENLDGVLNYPVYYPVVSAFQRVGGSISSLVDMIDTLKSECIDTTLLGSFLENQDNPRFPSYTSDESLIKNAIAFTILSDGIPIIYYGQEQGLNGGNDPYNREALWPTGYSTTSTFYEYIASLNQIRNHAIYIDDTYLTYQNWVIYSDSTTIAMRKGFTGNQIITVLSNLGSSGSSYTLTLSNTGYTASSVVYEILTCTAVTVDLSGNLAVPMSGGLPRVFYPESQLVGSGICSM

SEQ ID NO: 15367 - protein, 623 aa, Glycine max
  unsure (1)..(623): unsure at all Xaa locations
IEGKIIRLKQQXTLSMISLQNTYARFERRSGANVNWEEFPEKVAVQMNDTHPTVCIPELMRIMYRSGGVNWXNEGNITQRYEAISXHAVFAKAIKKWSLDLMQKLLPRHIEIIEMIDEELVRTIIAEYGTENSDLLEKKLKEMRILENVELTAEFADILVKSKEAIDIPSEEQQSSEQAEAEDEKDDDEVEAVAKKNGTDESSIEDEKEELPEPVPEPPKLVRMANLCVVGGHAVNGVAEIHSEIVKDDVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLMNIFGIVYRYKKMKEMSAAXREANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPXSYIECQEKVDEAYRDQTKWTRMSILNTAGSYKFSSDRTIHEYAREIWNIEPVQLP

SEQ ID NO: 15368 - protein, 509 aa, Nepeta racemosa
MVSLSYFLIALLCTLPFLLFLNKWRRSYSGKTPPPSPPKLPVIGNLHQLGLYPHRYLQSLSRRYGPLMQLHFGSVPVLVASSPEAAREIMKNQDIVFSNRPKMSIANRLFFNNRDVAFTQYGEYWRQIRSICVLQLLSNKRVQSFRRVREEETSIMVEKIMQLGSSSSTPVNLSELLLSLTNDVVCRVTLGKKYGGGNGSEEVDKLKEMLTEIQNLMGISPVWEFIPWLNWTRRFDGVDQRVDRIVKAFDGFLESVIQEHKERDGDKDGDGDGALDFVDILLQFQRENKNRSPVEDDTVKALILDMFVAGTDTTATALEWAVAELIKNPRAMKRLQNEVREVAGSKAEIEEEDLEKMPYLKASIKESLRLHVPVVLLVPRESTRDTNVLGYDIASGTRVLINAWAIARDPSVWENPEEFLPERFLDSSIDYKGLHFELLPFGAGRRGCPGATFAVAIDELALAKLVHKFDFGLPNGARMEELDMSETSGMTVHKKSPLLLLPIPHHAAP

SEQ ID NO: 15369 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 15370 - protein, 1188 aa, Neurospora crassa
MEWLSEFHTHLWKRAAEELNKNIKLINESDDPRIGSGRDGASGGTLSHSSGDNKDPASLSALGSTFVPVLVYAAICLLIFFTFRRISTRTYAPRTIAQLREPEHPAQTLPNGWIDWVKPFWKIDDDYILNNCSLDGYLFLRFLKILSVICFAGLAISWPILLPINATGGNLQRQLDKLTMGNIKLPSKYYAHVVVAWLFFGFVLFMVCRECIYYINLRQAYLLSPNMSNRLSARTVLFTCIPKPYLDEAKLRKLFGDSVKNIWIPKNTNYLRGLVEDRDDVAERLEKAEIELIKKANTVRMKNIREGKGAPPFAGEPAIDDLQSSKTSSSSLHESNESTQDGDLEKGTEPNPVRIRERRTEAPPIPVDEIETPALPGDDPGAPKKSKDDDLGPEYQHPYGYPASLPDVRGSVAALFVRANDRPHHRPLHNFGRRVDTIRWTRARLKVLNRDIWKLRRKFRAGDGQPLSSAFVEFDSQASAEAAYQILSHHQPMHMSPRYIGVRPEQVIWSSLRIRWWEQIMRQFLMLALVVVAIIFWSIPSAAVGIISNIDFLSEKVPFLFWIPLLPKVILGVIKGLLPAVALSMLMAIVPAGLRVCARVAGCPSHALVELYCQSAYFAFQVIQVFLVTTITSAASAAIIDVIKQPMSAPNLLAQNLPKASNFYLSYILVQCLGAGAGKLANVSDLLRHYVATSFMVDPRKAYHRWRKLTPIHWGAVYPRFTNMGVIALAYSCISPLILVFAGFGMLFVGLVYRYNLIYIHDDSELDTKGLLYPRALLHLMVGLYIAEICLIGLFALKKAFGPMLLMILFFGFCAITHYSLSSALSPLLASLPQTLALEKQHGQIAEDGDGDDHDINPVSRPTPSDPTSAQGGGGLAADYYNDTSISTPGADIPAEVIGGSAADYYASISFDYSDPSTDDPEPPGLYDDDFDSDGPQSQRMRGLEGSSSIRHSITEFAKTTLKSQLSNLKASANGTGPPGRLSPFTRFLYRIHRFLTPDPSIQNPNLIQRWLHPSVYADFRTLAKKVGNGPGPDGWELPKGYENKRGYYPPEMWKPAPRLWIPRDTGRVSRQEVRHNRDAGVWCTDVGCWLDDGVGEAPWDDGKDKRGSSEDSEKGVEGENMRGTEAEPESKEGKAMDLEDGKKVNRKGIWKGVGKEAKKATGRVKPGRVRVRFNVEEGPMGEERWLF

SEQ ID NO: 15371 - protein, 363 aa, Xanthomonas axonopodis pv. citri str. 306
MSASSILDLVREDLRAFAGYSSARTSALQGDVWLNANESAWANPADPDASTRRYPDPQPKGLRSALAALYGCAPEQLLIGRGSDEAIDLLVRGLCVPERDAVLVTPPVFGMYAVCARLQNAPLVDVPLVDGPDGFHADIPAIVAMALSSNAKLVFLCSPSNPAGSAIALDQIEQALQALQGKALVVVDEAYGEFSDVPSAVGLLGRYDNLAVLRTLSKAHALAAARIGTLIANAELIALLRRCQAPYPVPTPCAAMAEQALSAPALEVTRRRIAEVRSERERMHKALVQLPGVRQVYPSQGNFLLVRFDDAEGAFQALLEAGVVVRDQRAVPRLADALRITLGTNEQNQRVLSALQRTQEAAA

SEQ ID NO: 15372 - protein, 334 aa, Pichia ciferrii
MAITVGINGFGRIGRLVLRIALSRKDIQIVAINDPFIAPEYASYMFKYDSTHGRYSGEVSHEGENIVIDGKKIRVYQERDPVNIPWGKDGVDYVIDSTGVFKELDSAQKHIDAGAKKVVITAPSSTAPMFVVGVNEDKYTPDLNIISNASCTTNCLAPLAKIINNKFGIEEGLMTTVHSITATQKTVDGPSHKDWRSGPTASGNIIPSSTGAAKAVGKVIPELAGKLTGMSLRVPTVDVSVVDLTVKLLKDATYDEIKAAVKEAAEGPLKGVVGYTEDQVVSSDFLTDNRSSIFDAEAGIWLSPRFVKLIAWYDNEYGYSTRVVDLLEYVASKN

SEQ ID NO: 15373 - protein, 154 aa, Oryza sativa
FLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTMPVYSEQFSHIGSSAIFC

SEQ ID NO: 15374 - protein, 391 aa, Streptococcus criceti
MKFETSHLLKKLPKQFFADLVTKVNAKIAQGADVINLGQGNPDRPTYDFIVKALQDSAAKPASHKYSLFRGNPPFKEAAADFYKANYQVDLDSQTEICVLGGSKIGLVELPWALMNPGELLLLPDPGYPDYLSAVALGQVDCETYPLLAENDFLPDLTAIPEESARRAKFIYINYPNNPTGAVATPAFYESLVDWAKKYEVGVVSDFAYGALGYQGYKNPSFLSTPGAKDVGIELYTFSKTFNMAGWRLAFAAGNADMIEALNLIQDHLFVSIFPAIQDAGVAALSDPRAKEAIAALNQRYDQRREAFVQAAAQIGWQAFPSKGSFYAWMPVPEGFNSQNFADLLLEEAHVAVAPGIGFGQEGDSYVRIGLLVEPDHLAQAVERIGQLDLF

SEQ ID NO: 15375 - protein, 328 aa, Oceanobacillus iheyensis HTE831
MTESQLGISNDIALGMYEMMLLARKLDERMWLLNRAGKIPFVISCQGQEAAQVGAAFALNRTTDYIAPYYRDLGVVLAFGMSAQDVMLSAFAKAEDPNSGGRQMPGHFGQKKNRILTGSSPVTTQLPHAVGVALAAKMDKEPLVSFVTLGEGSSNQGDFHEGLNFAGVHKLPVITMVENNKYAISVPYDRQVASETISERANSYGMPGVTVDGNDPVAVYQAVSEARDRAVRGEGPTLIEAITYRLTAHSSDDDDRAYREKNEVEEAKKKDSIITFATTLKEAGVLKDEKEQEIMSRIDELVNEATDYAENASYAEPEDALRYVYEEE

SEQ ID NO: 15376 - protein, 332 aa, Brucella suis 1330
MKTGRTDRPRILIVSTGGTIASRYDPQTDSLLSVSTGNELLSSLGALAPAVDVVLDEFCNLGSNRIDLDTSFRLAHHIDERLRDRTVDGCVVTHGTDTLEESAFLAQLTISSRKPVVFTGAQRSADEPDADGPRNLADAISVAASPEARDLGTLVVFAGKVLSSIDATKIHTSKLEAYDAPGYGPLGVVDHGAVFITRKPLGYPMIAAHSIETRVDLITLAMGADGRLIEAAINSGTHGFILETFGRGNATPAVVDAVARATERGIVTIITSRCPDGRVLPVYGDGGGSDLEKAGAIFAGRLNGPKARILLCLSLPTIPVEELGRLFEQFGR

SEQ ID NO: 15377 - protein, 285 aa, Bacillus anthracis str. A2012
MPLVSMKEMLNKALEGKYAVGQFNMNNLEWTQAILAAAEEEKSPVILGVSEGAARHMTGFKTVVAMVKALIEEMNITVPVAIHLDHGSSFEKCKEAIDAGFTSVMIDASHHPFEENVETTKKVVEYAHARNVSVEAELGTVGGQEDDVIAEGVIYADPAECKHLVEATGIDCLAPALGSVHGPYKGEPNLGFAEMEQVRDFTGVPLVLHGGTGIPTADIEKAISLGTSKINVNTENQIEFTKAVREVLNKDQEVYDPRKFIGPGRDAIKATVIGKIREFGSNGKA

SEQ ID NO: 15378 - protein, 324 aa, Chloroflexus aurantiacus
MEAETRRIVTTLGDINVDLGFLLPHFPREGDDNPAMAVHWGGGGAGLNMAVAVGRLGAIPYLIGRVGNDLAGSFALQTARTHGVQVSTVQVDPGAATGLCGIVVTPGGQRSFLSFRGANVFCDASTITPSLIRSSRLLLIGSHALLDDPQRSAALQAMELAIEQRCPIVLDLCLPAIRVARRLIVRLLPQLWLLTMNEDELRALLPGQSIAQALDSLLSAGVQHVAIKRGAQGCSVANNQGRRLDVLPPAVSVVDTTACGDAFSAAYAWALIHGLDLSQSATLANLVGALTATRHGAVEAIPAADEIRSRLNVTIADRLWPSVP

SEQ ID NO: 15379 - protein, 152 aa, Zea mays
MMSAKRIAHLAKKWQRMAAQRRQRITWGGAGAAAKQAGESCSSVASKGHCAVYTADGARFEVPLACLSTLVFRELLEMSQEEFGFSGGDGSGRITLPCDTAVMEYAMCLLRRSASAELEQAFLSTVAATSCCHYASRVALATCVGAGLRVAV

SEQ ID NO: 15380 - protein, 169 aa, Picea mariana
ELHRQFLALGVGVIEDVRVQRDKGFGFVRYRSHEEAALAIQLANGRVICGKSIKCSWGSKPTPPGASSNALPPPSAPFQGVVAPQGLNQGYTAADILAYRQLNMSQAGAGQPLLPLSAQQGMGLGLGHGPMGVVGPNQNVYDNFQAGAGLPAAAAAAAAAMRQQIMYYQ

SEQ ID NO: 15381 - protein, 195 aa, Corynebacterium glutamicum ATCC 13032
MSKDPLGSLTDVVDTRVPLPDVEPDPEFLKATEKEFHMASQKRALVVLVGDHVAEADGTGRLVTELLLESGFNVDAVVSVKSKKSQIRQAIETAVVGGADLVLTIGGVGVGPRDKTPEATSAVLDQDVPGIAQALRSSGLACGAVDASVSRGVAGVSGSTVVVNLAESRSAIRDGMATLTPLVDFVVDQLRTSVV

SEQ ID NO: 15382 - protein, 261 aa, Zea mays
  unsure (1)..(261): unsure at all Xaa locations
RGRVQTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPSLGSLVAFQAMVSIATIGLYISYALPILFRVTLARKYFVPGPFNLGRYGVLGGXVAVLWXGSTITVLSSLPVTYPATKDTLDYTPVAGGELLFLVLASSLINARHWFKGPVTNLDG

SEQ ID NO: 15383 - protein, 180 aa, Serratia plymuthica
EVGVDVVAEATGIFLTDETARKHITAGAKKVVLTGPSKDATPMFVRGANFDKYAGQDIVSNASCTTNCLAPLAKVINDNFGIVEGLMTTVHATTATQKTVDGPSHKDWRGGRGASQNIIPSSTGAAKAVGVVLPELKGKLTGMAFRVPTPNVSVVDLTVRLEKAATYEEIKKAIKDAAEG

SEQ ID NO: 15384 - protein, 189 aa, Ferroplasma acidarmanus
MVYMKKILIIDNYDSFVYNIYQYISSPEIHVDIRTNDNLTDLEPYDGYIISPGPGNPKNSEDRGGLYEFIDRNKEAKFLGVCFGNQILGYYLGSDITLSKRLMHGQPDTISHGDSLLYRDVPEKFTAIRYHSLVLEPGSNIIVDAVSETDGEIMGFHSKDGRFFGVQYHPESYYSEYGKQIFKNFVDAI

SEQ ID NO: 15385 - protein, 464 aa, Oryza sativa
MAAAGEERGGGASGGASPADEESMRRTGSEARGAGTGCGVPARRRSRAGGGVPPRVPTRHRREGARRPPCVPARPQRRGGARRPPQSPRAHDEEEEPAMAAVSLHASPRATAEEEPAAHRAFPCAHDEDEEPAAHRVSPRTRSASASIAGRRRPRAPTAPRAPPSLPRQSHQRVAGVGVLHLASSTAASVSALMSAPSAPPSALSLLTVHADCPSLRRPRQLTTPTARPRRVHCGGNSDDRDSLRDLTCAMWSPGSWGLDKLPVNYLRRFRPVREPPLSCLWSSRRLRFTFSMHGCDDDVDTIDSISLLVLPCRTPVRPKPLATVASPGVKYLSIGEMEAQPPAHAQLGGSATLAKAGGREAAAEEEVVLWREDARRFETPDGEAYLQYRLLAAAQPRSSSSGDGGGGGGATTPAAVMEMAHTYVPGSKRGRGLAARLCDAAFAHARERGMRVLPTCSYISVRL

SEQ ID NO: 15386 - protein, 597 aa, Zea mays
  unsure (1)..(597): unsure at all Xaa locations
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMVVIASMFIVRPVGGHRQVRPSDGTSFTFVYSVCLLLASYLMGVMLLEDLVDLSQSVTVVLTVILIMFLLVPIVIPVLLSFFSDDDETLYALLLPSPRKEEPSASTSSEEQQEVILSEVEDEKPKDVDLLPASERQKRIAELQTRLFQAAADGAVRVKRRKGPRRGEDFTLMQALIKADFWLXFLSLLLGSGSGLSXGIDNLGQMSQSLGYEETHIFVSMIGGWNFLGRIGGGYFSEIIVKDYAYPRAIALGIAQILIAIGHFNFAMAWPGTMYVGTLLVGVGYGAHWAIVPAAASELFGVKNFGALYNFLTVANPAGSLVFSGVIASGIYDAEAAKQAQQRHSTSKLLATSGRVVSVVSEAAPALKCEGAICFFLSSLIMAGFCVVAFGLSLILVYRTKVVYAGLYGKPRT

SEQ ID NO: 15387 - protein, 595 aa, Magnetospirillum magnetotacticum
MEESMSGEVMTGAQMVIRAFQDQGVDTLFGYPGGAVLPIYDALFDETTIQHVLVRHEQGAVHAAEGYARSSGKVGVVLVTSGPGATNIITGLTDAMLDSIPLVAVTGQVPTHLIGSDAFQECDTVGITRHCTKHNYLVKSIEDLPRILHEAFYVASHGRPGPVVIDLPKDVQFATGVYSRPTQNGHKTYNPPVKGDSEKIRAAIELMAGARRPVFYTGGGVINSGPEASRLLRELVAETGFPVTSTLMGLGAFPASDDKFLGMLGMHGTYEANLAMHDCDVMICIGARFDDRITGRLDAFAPYSKKIHVDVDASSINKVVKVDVGILGDCAAVLEEMLAQWRALPKQPDKGRMEDWFNKISRWKSRDCLAYWPSGTIIKPQYAVQRLYEACKDRKTFVTTEVGQHQMWAAQYFKFDEPNRWMTSGGLGTMGYGLPAAIGTQLANPDGLVIDIAGEASILMNMQELSTAVQYRLPVKIFILNNEYMGMVRQWQELLHGSRYSQSYSESLPDFVKLAEAYGAKGIRCEKPGELDAAIQEMLAYDGPVIFDCVVDKTENCFPMIPSGKAHNEMLLSDYLGETGVELGDVISAEGKMLV

SEQ ID NO: 15388 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 15389 - protein, 533 aa, Ralstonia metallidurans
MALFFSRPAFLSYDAAHLHGRQPMSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 15390 - protein, 421 aa, Magnetococcus sp. MC-1
MTETAPFMGVGWLCRLSSCMNGPSMEEFHRIKRLPPYVFAVVNELKYKARNRGEDIIDFGMGNPDQPTPKHITDKLIEAVQDGRNHRYSLSRGIGGLRRAVCAYYKRRFGVDLDPESEAIVTIGSKEGLSSLAMAITEPGMNVIVPSPTYPIHEYSFLIAGAHIQRVKISRDNDFIEDMKVAVRNHWPRAQVLVVNFPSNPTAQVVELDFYQKVIDFAKEHNIWVISDVAYAEICFDGYKAPSILQIPGAKDIAVEFYSLSKTYNMPGWRVGFCVGNPHLIKALSRIKSYLDYGMFQPIQIAATVALNGPQDCVAEINEIYRQRRNVLIDGLARAGWAIERPKASMFVWAEIPDEFKAMGSLEFSKLLLKEAKVAVSPGVGFGVYGDDHVRIALIENEHRTRQALRSMRRFLSAGSDVAGD

SEQ ID NO: 15391 - protein, 221 aa, Zea mays
EIALLGQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNIEWTNAFFMIGRGEQPTIPCYLSKEAQDFIGQCVRVDPESRPSASQLLEHPFVNRPLRASFESSSPPAI

SEQ ID NO: 15392 - protein, 349 aa, Flaveria brownii
EFYIGLRQRRATGQEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNIPLEESRKKVWLVDSKGLIVRSRLDSLQHFKKPWAHDHEPVDKFLDAIKTIRPTVLIGSSGTGQTFTKEVVETMSSLNEKPIILALSNPTSQSECTAEQAYTWSEGRAIFASGSPFGPVEYNGKLYMSGQANNAYIFPGFGLGLIISGAIRVHDDMLLAASEALAEQVTEEHFDNGLIYPPFTNIRKISAHIAAKVAAKAYELGLASRLPQPENLVAYAESCMYSPKYRSYR

SEQ ID NO: 15393 - protein, 793 aa, Oryza sativa (japonica cultivar-group)
MEKDHQPVISLRPGGGGGGPRPGRLFSPAFAAAASGSGDLLRSHVGGASKIGDPNFEVRERVRYTRDQLLELREIVDIPEAILRINQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPWSARRGNLSEKDRVLKTVKGILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAMKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASLTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSGQAILSSHAVVIDACNKLLK

SEQ ID NO: 15394 - protein, 477 aa, Pseudomonas fluorescens PfO-1
MNKLTTAAGAPVVDNNNVQTAGPRGPMLLQDVWLLEKLAHFDREVIPERRMHAKGSGAFGTFTVTHDITRFTKARLFSSVGKTTDVFVRFSTVAGERGAADAERDIRGFAIKFYTEQGNWDLVGNNTPVFFLRDPLKFPDLNHAVKRDPRTNMRSARNNWDFWTLLPEALHQVTIVMSDRGLPRTYRHMHGFGSHTFSFISPANERFWVKFTWKTQQGIENLTDQQAATLIGDDRESAQRDLYNAIEEGHFPQWKLYVQVMPELDAETYPINPFDLTKVWPHADYPLIEVGVLELNRNPDNYFADVEQAAFNPANVVPGISFSPDKMLQARLFSYGDAQRYRVGVNHHQIPVNAPRCPVNSYHRDGQMRTDANAGSTIGYEPNSYGQWAEQPDFSEPPLALKGSAGHWNHREDDDYFSQPGALFRAMSTAQQQVLFENTARSIHGASAQTRQRHIDNCTRADPAYGAGVAQAIEALG

SEQ ID NO: 15395 - protein, 483 aa, Bacillus anthracis str. A2012
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFEKAVGQLKVGDGFGDGTTVGPLIDENAVSKVQEHIEDAIQKGGTVLYGGQKVAELDGHFMQPTVIGLANDTMLCMNEETFGPVAPVAKFKTVEEVIERANHTPYGLAAYIFTKDISQAFQISEALEYGIIGLNDGLPSVAQAPFGGFKESGIGREGGHFGIEEYLEIKYISLGL

SEQ ID NO: 15396 - protein, 265 aa, Escherichia coli O157:H7 EDL933
MLAGLRFMLVAFPAIFFVARPKVPLNLLLGYGLTISFAQFAFLFCAINFGMPAGLASLVLQAQAFFTIVLGAFTFGERLHGKQLAGIALAISGVLVLIEDSFNGQHVAMLGFMLTLAAAFSWASGNIFNKKIMSHSSRPAVMSLVVWSALIPIIPFFVASLILDGSGKMIHSLVTIDMTTILALMYLAFVATIVGYGIWGTLLGRYETWRVAPLSLLVPVVGLASAALLLDERLTGLQFLGAVLIMAGLYINVFGLQWRKAVKVR

SEQ ID NO: 15397 - protein, 433 aa, Vibrio vulnificus CMCP6
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 15398 - protein, 333 aa, Streptomyces hygroscopicus
MSAALTDGTVQGQQQCDTRLVGLYEADEAGSDLTLALSLAHGRAEAAARGIPLHTHLWQLYGGRTAPGLPRLMVNVFSGGIHRTGPPRGFQQVMVLPATGGLHTDIEVADRVFTAAHRNVERRFGPVPLSASSGLMVPLDSAGQLDLLQAAVAETGHTEVCTLGVDVAAEHLLTEPGRYRFGDRVLTAPDFADHLADLAHRFRMSFLEDPFDAADEAGWARLRGALPATTSVVGDDLFATDATRIEPGRADGILLKLSQAGTVTATLAAAAAARRAGMLLSVSHRSGETEDTAMCDLAVAVGAELIKVGGPRRGDRLAKYNQLLRLDESVAAP

SEQ ID NO: 15399 - protein, 401 aa, Zea mays
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKILETIGKKLKKNNVALDIVDFGESDDEKPEKLEALIAAVNSSDSSHIVHVPPGENALSDVLLSTPIFTGEEGGSGFAASAAAAVATGASGFEFGVDPNVDPELALALRLSMEEERARQEAIAKKAAEDTSNTENINASSSNSDSVMAEAELASNAAAGDKQEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDKSDKTEDEKN

SEQ ID NO: 15400 - protein, 557 aa, Triticum aestivum
APPRTTQRYRTPAPTTSVERPAQPPTAPSAPRARHFWVSQEAGLRGEGHPKTKPRIQQSPFGRYWYDKESGLWGKDGQKPDRIVSSNLNFSGKLHAKASNGNTQVYINGREITKSELKILKVAHVQCPRDTHFWVYDDGRYEEEGQNNIKGKIWESALTRFACALFSLPVPPGDSNGTKDEIPFVPRTVPDYLDQKRIQKLLILGSPGAGTSTIFKQAKLLYGSRFTPEELDNIKLMIQSNMFKYLGILLEGRERFEEEALAISNNPNSEDEDTQQDGNESNGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERSPMSELYIDSQEASSQPLTKYQLIRVNAKGLNEGCKWVEMFEDVRAVIFSVALSDYDLLGTPVNGNLQNKMMQSKELFEATIRQPCFCDTPFVLVLNKYDLFEEKISRAPLTACEWFGDFSPVRTQSNNQTLAQQAYYYVAMKFKEAYNDHTGRKLFVWQA

SEQ ID NO: 15401 - protein, 784 aa, Triticum aestivum
  unsure (1)..(784): unsure at all Xaa locations
MTTDQPVISLRPGGGGGGPRGGRLFAPAFAVAASGSGDFLRPHGGGAXRRLQDWXLHSEARERVRYSRDQLLDLRKITDVTEQILRLQQEIEAELHGDDQSWVRNDSNVQLQTKINAKFSVLDQCQGRDPRGNHQGPLINKVSSINKPSPINPSLVPQDTGAPSGRRQLQFTGRQPSRPPSLEVGPPPSLSXAYIPWSALKCNLSFCTYSLKTVKGILNKLTPAXFDLLKGXLLDSGITTADILKDVISLIFEKAVFELTFCPMYALLCSEHNDNLPESPSKVPGGKYTXKIARRKIWIRMPCFRVRDCKLMVLTLVNAPTQFGEVVARLILSCGLRFEAVEGILKAMEDTYFLKAIFSAVTKTLEADPAGQAILSSHASRSSNAVQQACSDINSSWQLNHSHGRXCLVKKQAYGVFSIAWIVSPQRNRDVSHHVVLTCRFLRGHMSVDFCCEERKNPWPARAGRRRPNXPLEPGNEQGFFVFKMGCFCVSSNVIISFQFLHNLXNVLWXLEYSVGYNISCQHCRKRKLSKKLSLINKPPPSHPRLIPQGTGALIGKSAGKSALLGTGGPPSRPSSLTASPTPLPAQTTASPKPSSATPASVPIPDKAASSAKVIPAGLQKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVVARLILSCGLRFEAVEGILKAMEDTFFRKAIFTSVTKTLEADPAGQAILSSHAAVVDACNSLSI

SEQ ID NO: 15402 - protein, 166 aa, Brassica rapa subsp. pekinensis
VEEYEEHMKKLASKLMWLALNSLGVSEEDIEWASLSSDLNWAQAALQLNHYPVCPEPDRAMGLAAHTDSTLLTILYQNNTAGLQVFRDDLGWVTVPPFPGSLVVNVGDLFHILSNGLFKSVLHRARVNQTRARLSVAFLWGPQSDIKISPVPKLVSPVESPLYQSV

SEQ ID NO: 15403 - protein, 409 aa, Emericella nidulans
IMNLAYWFRATYNTEVPGSMRAPIQMTHDNTALTVSEREAIRVEEDAKRRLLANRKLSLVVDLDQTIIHAAVDPTIGEWMADKDNPNHAPVSDVRAFQLVDDGPGMRGLLVLCKLRPGLEEFLKNVADMYELHIYTMGTRSYAQAIANIIDPDRKLFGDRILSRDESGSLSVKNLHRIFPVDTKMVVIIDDRGDVWRWSPNLIKVIPYDFFVGIGDINSSFLPKKQELETPGENQEQNPTPPIQQQVNGLAEKSDATELSTLEQLVTMGGGDNPRLLQEQTEAQDVTILHQVEDRPLLQKQKELDAEDESADSRESGLNESRDSAKPRHHLLIDNDQELIKLSDRLEQVHRKFYEEYDQKPGARLRGRVAALRGERAISKEKDVDLKLVPRCQRYPASDKAPHYGKCSP

SEQ ID NO: 15404 - protein, 217 aa, Medicago sativa
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHGTFENVRQMAERTAKPHRFQHCCVLVGNKADLRHLVAVSTEDGKSYAEKESLYFMETSALEATNVENSFAEVLTQIYRILSKKAVEGAENGNASVPAKGEKIDLKNDVSALKRVGCCSS

SEQ ID NO: 15405 - protein, 468 aa, Azorhizobium caulinodans
MKTAKEVLDFIKSNDVKYVDLRFTDPRGKWQHVTFDITMVDEDFFAEGQAFDGSSIAAEAINESDMLLMPDVTTACVDPFFSETTLSVVCDVLEPTTGEPYGRDPRGIAKKAMAYLQSTGIGDTVFFGPEAEFFIFDDVKFKADPYNTGFKLDSIELPTNGDTDYEGGNLGHRIKTKGGYFPVPPLDSAQDMRSEMLASMAKMGAKVEKHHHEVASAQHELGLKFGQLVTMADHLQVYKYCIHQVANIYGKTATFMPKPVYGDNGSGMHVHQSIWKDRKPLFAGDKYADLSQECLWYIGGVIKHAKSLNAFTNPLTNSYKRLVPGYEAPVLLAYSARNRSASCRIPYTNNPKAKRVEVRFPDPGANPYLAFSALFMAGMDGILNKIDPGSAMDKDLYDLPPAELKQIPTVCCSLREALESLAKDHDYLLKGDVFQKDFIESYIDLKMQEVARFEMTPHPVEFEMYYSV

SEQ ID NO: 15406 - protein, 419 aa, Staphylococcus epidermidis ATCC 12228
MSVEKRTPISVKEAIKRIMKQHVEVKNININLDESLGHILAEDIVATYDIPRFNKSPYDGFAIRSEDSQGASGENRIEFEVIDHIGAGSVSEKTIDKNQAIRIMTGAQIPSGADAVVMFEQTIESETTFTIRKSFKHLENISLQGEEIKAGDIVLHKGMRINSGVIAVLATYGYTKVRVARKPTVAVIATGSELLEVEDELEPGKIRNSNGPMIKALAKQFGIQVGMYKVQHDNLEKSIEVVKKALSEHDLVITTGGVSVGDFDYLPEIYKSIQAQILFNKVAQRPGSVTTVAFADGKYLFGLSGNPSACYTGFELYVKPAVNKLMGAKACYPQIIKATLMEDFNKANPFTRLIRAKATLTKAGMTVIPSGFNKSGAVVAIAHANAMIMLPGGTRGFKAGNIVDVILTESNSFEEELIL

SEQ ID NO: 15407 - protein, 94 aa, Glycine max
GESFSNIPTNAVNAVTWGVFPGKEIVQPTVVDSASFMVWKDEALAIWSKGWARLFPEGDSSREIVDKVQKSYFLVSLVDSDYINGDLFAAFKEI

SEQ ID NO: 15408 - protein, 338 aa, Sinapis alba
MADKKIKIGINGFGRIGRLVARVILQRNDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESQGKLKGILGYTEDDVVSTDFVGDNRSSIFDAKAGIALSDNFVKLVSWYDNEWGYSTRVVDLIIHMSKA

SEQ ID NO: 15409 - protein, 599 aa, Brassica napus
MSHLLPLKKPTRTRLSSPATLPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQILDELTEGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 15410 - protein, 649 aa, Bifidobacterium longum DJO10A
MQAFSGVPKINTAPDKQTIVDGEKMTGAQALIRSLEDLGVEDVFGIPGGAILPVYHEIKDNTKFRFVLMRHEQAAGHAAEGYALATGKVGVCIVTSGPGATNVVTAIADANMDSVPMVVITGQVGVQAIGTDAFQEADIVGITYPVSKHSFLVTRAQDIPRVLSEAYYIANTGRPGPVVVDLTKTAQTGDMYYSWPQRMILPGYNPTTKAHGRVLSDAAKLFSQSYRPVLYVGGGAARSNAGAQVKALADLTGAPVVTTLPARGIIPDSDPKNLGMLGMHGTIAATGAVQRADLLVAIGARFDDRVTGKLDAFAPTARVIHIDIDPAEIGKNRQPDVPIVGDVATVLDDLIPEIQRTQAIQGKPNLAPWWKAIDGWREEYPMTWDEPTDGSLAPQWVIKKLSEMADPSTIWVTGVGQHQMWASQFIDFENQHAWISSGGLGTMGYGLPAAIGASVGSAREFEGKKPVWLIDGDGSFQMTSEELAAAFLDHAPVKIAILNNSVYGMVRQWQTLFYEHHYSQTNLLDGEAHGADGAAALADGDAPLEVPDFIKLAEAYGCVGIRAFTEEEAIAAIEKANQINDRPVLIDFRVWKDAMVWPMVAAGAPNDEVTYKPGIKPLAGGTPAPGTGPDEHATGVFEHETAAATASEH

SEQ ID NO: 15411 - protein, 471 aa, Pseudomonas aeruginosa PAO1
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 15412 - protein, 419 aa, Neisseria polysaccharea
FTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKVAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 15413 - protein, 304 aa, Zea mays
MAGLSLEHPWAFAFGLLGNVISFMTFLAPIPTFYRIYKSKSTEGFQSVPYVVALFSAMLWIFYALIKSNETFLITINAAGCVIETIYIVMYFVYAPKKAKLFTAKIMALVNGGVFGVILLLTLLLFKGSKRVVLLGWICVGFSVSVFVAPLSIMRRVIQTKSVEYMPFSLSLSLTLSAVVWFLYGLLIKDKYVALPNILGFTFGVVQMVLYVLYMNKTPVAVAEGKDAGGKLPSAADEHVLVNIAKLSPALPERSSGVHPVVAQMAAVPNRSCAAEAAAPPAMLPNRDVVDVFVSRHSPAVHVV

SEQ ID NO: 15414 - protein, 449 aa, Agrobacterium tumefaciens str. C58
MQLNKFLTLGKLGAAATALMAPAIAFAQDAAPAVAAAAPVPEKADTAFMYIATILVLFMIIPGLALFYGGLVRTKNMLSVLMQCTVIGAVMMLVWVIYGYSFAFGGGTGPYFGGFGKLFLSGVSLDSTSATFSQGVVIYEYTFIAFQMTFAAITPALIIGAFAERVKFSAVILFTILWATFVYFPIAHMVWDANGLIFGMGALDFAGGTVVHINAGIAGLIGAIMVGKRTGFGKDMMAPHSMTLTLVGAAMLWFGWFGFNAGSNLEASGGAVLATMNTFLATAAAIVSWSLVESFTRGKASMLGAASGMIAGLVAVTPAAGSVGPMGAIVLGLIVSPICYFFVSVVKNKFGYDDTADVFGVHGIGGIIGALGTGIFTSPLLGGTGKADFSISSQLWTQFVAVAITIVWCAVVSAILYKIVDVIVGLRVPVEAEREGLDLATHGEAAYHS

SEQ ID NO: 15415 - protein, 329 aa, Glycine max
MGSNGGSSNNNNNKVLEKPGQDQLVQQQQHPQEAPKCPRCDSSNTKFCYYNNYSLSQPRHFCKACKRYWTRGGTLRNVPVGGGCRRNKRVERPITSPCSAAIDTASNSSNSSSAPTAAASLQPQIDTASTSNHINPLFYGLPSSSSDVNLPLFSRFGSRISSSGFDLQLNNALGLGFSSRVLSNEASDNNRYRSGFGSNNMLLSSYTSTTTTTPAMSSLLLQQKFISGGLKNDADSSNTFQHGLSLTSLEQLQIASDHSSEAGMVALKDVKVELGQNNNRLEWNGGAFQSQIQHVGLYDPLLYWNNSATALGVWNDQAANIGSSVTSLI

SEQ ID NO: 15416 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFNLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 15417 - protein, 353 aa, Hypocrea virens
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFIQPAQIEGDVLPPEVGGAIEALWKDHGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 15418 - protein, 521 aa, Arabidopsis thaliana
MDSCCNFSLGTKTVLAKDSFKNVENKFLGEKIKGSVLKPFSSDLSSKKFRNRKLRPGVAYAIATSKNAKEALKNQPSMFERRRADPKNVAAIILGGGDGAKLFPLTKRAATPAVPVGGCYRMIDIPMSNCINSCINKIFVLTQFNSASLNRHLARTYFGNGINFGDGFVEVLAATQTPGEAGKKWFQGTADAVRKFLWVFEDAKNRNIENIIILSGDHLYRMNYMDFVQHHVDSKADITLSCAPVDESRASEYGLVNIDRSGRVVHFSEKPTGIDLKSMQTDTTMHGLSHQEAAKSPYIASMGVYCFKTEALLKLLTWRYPSSNDFGSEIIPAAIKDHNVQGYIYRDYWEDIGTIKSFYEANIALVEEHPKFEFYDQNTPFYTSPRFLPPTKTEKCRIVNSVISHGCFLGECSIQRSIIGERSRLDYGVELQDTLMLGADSYQTESEIASLLAEGNVPIGIGRDTKIRKCIIDKNAKIGKNVVIMNKDDVKEADRPEEGFYIRSGITVVVEKATIKDGTVI

SEQ ID NO: 15419 - protein, 152 aa, Glycine max
  unsure (1)..(152): unsure at all Xaa locations
MAFAHYLLAVPVEPSPNFPTNPPKPNPSLSSSSSSSISSHCFNLSSSLRPKHSLFSRFRRICHKAKAKPQEPEVTVASDAFTQFKHLLLPITDRNPYLSEGTRQXIDAQQKESLPEHETQLSSIRWHLSEGGLKDYNLLERLGDGXKPTAII

SEQ ID NO: 15420 - protein, 425 aa, Triticum aestivum
MAPELKVPLLEGRGATPAQTLGNILVSIVGTGVLGLPFAFRAAGWLAGALGVAAAGAATFYCMLLLLDCRDKLREQETEEDGLGDERRLNRGDGGNYTYGDLGERGFGPVGRYFTEAIIIIGQTGGSVAYLVFIGQNLSSVLPALSPPAVVLALLLPAEVALSFVRSLSALAPFSILADACTVLAVAAVVKEDVQLLAKRGRPFAGRSAFAGLWGVPFACGVAVFCFEGFCLTLALEASMSNRGRFRPVLFQAIVGVTIVYISFGVCGYLAYGDDTRDIVTLNLPDNWSTAAVKVVLCVGLALTFAVMMYPIHEIVEARLLAPGGWVRRRCGGVVQRAALHLSRVAVVAALAAIACFVPAFGDFVAFVGSTVCALLSFVLPALFHLRFVGPTASPWARAVDYFLLLAGLVFAGHGMYTVLAPIYN

SEQ ID NO: 15421 - protein, 507 aa, Streptomyces coelicolor A3(2)
MTRYAAPGTEGAIVSYQSRYDHFIGGEYVPPARGQYFENPSPVNGLPFTEIARGTADDVERALDAAHEAAPGWGRTSVTERSDILLKIADRMEANLERLAVAESWENGKPVRETLAADIPLAIDHFRYFAGAVRAQEGSLGEIDDDTVAYHFHEPLGVVAQIIPWNFPILMATWKLAPALAAGNAVVLKPAEQTPASIHYWLSLVADLLPPGVLNVVNGFGVEAGKPLASSPRVAKVAFTGETTTGRLIMQYASENIKPVTLELGGKSPNIFFEDVWARDDDFRDKALEGFTMFALNQGEVCTCPSRALVQRGVYAEFMEAAVARTELIKPGHPLDTDTMIGAQASNDQLEKILSYLDIGRQEGAKVLTGGERIEHDGELKGGYYVQPTIFEGHNRMRIFQEEIFGPVVSVTSFDDFDDAVKTANDTLYGLGAGVWTRDMNTAYRAGRAIQAGRVWTNCYHAYPAHAAFGGYKQSGIGRENHKMMLEHYQQTKNILCSYSPKKLGFF

SEQ ID NO: 15422 - protein, 234 aa, Escherichia coli CFT073
MPRLALRRPLPNIQVNQVAKYMTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 15423 - protein, 343 aa, Neisseria meningitidis MC58
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGPLKGVLGYNTLPLVSMDFNHTTEASHFDATLTKVVDGNMVKVFAWYDNEWGFSCQMLNTARRMFGLEVRPLK

SEQ ID NO: 15424 - protein, 458 aa, Zea mays; identical to SEQ ID NO: 1403

SEQ ID NO: 15425 - protein, 391 aa, Guillardia theta
MIDQAIFLQDFFRKYSVILDLEVILNIFIIIQRFIKNQDNYNKNYLKSLISKIKGEPISTALLEEKLDNNKAIISTPLGSEYYVDVCSFVDYDRLYIGESVQIHHKSLSIIGGFNEISNSLINLGKIEKHSTVTFNDIGGLETQILEIKEAIETPFNKPEIFYNIGIDPPKGVILYGEPGTGKTLLAKAIASKTKANFIKITGSELVQKFLGEGPRLVRDLFKTAHKLSPCIIFMDEIDAIGTIRTDSHSEGEKEVQRTMLELLNQLDGFTTNQNIKIIMATNRIDTLDPALIRPGRIDRKIEFSLPDDRTINKILTVHTKKMNVGKDVNLISFLTSKDYVSGADIKAFCTEAALIALGKRRIHLIQDDFNEAKNYIMKKKKESNFEIIYQ

SEQ ID NO: 15426 - protein, 246 aa, Daucus carota subsp. sativus
MGRGKVELKRIENKINRQVTFAKRRNGLLKKAYELSVLCDAEVALIIFSNRGKLYEFCSTSSMNKTLGRYHRCSYGALETGQTDRDTQSSYQEYIKLKAKVEALQQSQRHLLGEELGQLGTKELEELERQLDSTLRQVRSTKTQYMLDQLSDLQQKEQELVEINKALRNKLEENDVRIQSQWEAAERNNVAYRSHPAEHPPDHGVFESLECNNTMHMGYNSAMNDHQMASATPTQNASGVIPGWML

SEQ ID NO: 15427 - protein, 760 aa, Cephalosporium caerulens
MARATGSEAQETEQALSRKRSSGPCGEGPKHDFPKRPKIEKGTDPTRWRMRDDESRHTWHYLPSEEAAKAWPQTCADKYYLNLPLGLPSLPQPTTPLDSARNGLTFFEKLQLPSGHWGCEYGGPMFLLPGIVIAWYVTRTPIPSAYATAMKDYLSARANQDGGWGLHIEGETSAFGTALNYTALRLVGVEANEPMMIKARAALHRLGGALNAPHWTKFWLAVLGVMDWDVVNPVPPELWLLPDWVPIAPWRWWIHIRQVYLPMGYLYSKRWSCEETETTRSLKEELFVQPHAEINWAAHRNDISVMDNYHPKSWVLNTANWFLVNIWNPYLRTNGIKERAEKWTSELIDMEDKNTDYSDLAPVNAPMNTVACYVRDGPDSYSVRRHLERLEECLWVKDEGMLVNGTNGVQCWDTSFLVAAFCEAGLHHEDRWQPMLRRALEFLEKQQLRENVQDQAKCYRQTRKGGWPFSNKDQGYAVSDCTSEALKAVIKLQKTQGFPQLLDDRRIFDTVDTLLLYQNDDTGACSSYENRRAGEWMEMFNAAEVFGNIMVEYDYPECTTSCVTALNLFRKHWPEYRAEDIEKFIKRATNWIRGSSLHLSSGGRMAGWYGSWGICFTYATMFGLESLASIGETYSNSDVAKRACDYLLSKQREDGGWSESYKSCETMQWHEHPDGSQVVQTAWALIALMHGQCPDIAAMKRGIKLIMERQQPNGEWLQEAIEGVFNKSCMISYPNYKFIFPITALGMFGNRYPDEKIDLN

SEQ ID NO: 15428 - protein, 541 aa, Medicago sativa
MAIEMSSIVSKLSMLSTSDHASVVSMNLFVALLCACIVLGHLLEENRWMNESITALLIGICTGVVILLFSGGKSSHILVFSEDLFFIYLLPPIIFNAGFQVKKKQFFVNFMTITSFGAIGTLISCVIITTGATFAFKRMDIGPLEIGDYLAIGAIFAATDSVCTLQVLNQDETPLLYSLVFGEGVVNDATSVVLFNAIQSFDLNQLNPSIALHFLGNFLYLFVASTLLGVVTGLLSAYVIKKLYIGRHSTDREVALMMLMAYLSYMLAELTYLSGILTVFFCGIVMSHYTWHNVTQSSRITTKHSFATLSFVAEIFIFLYVGMDALDIEKWKFVSDSPGTSIAASSVLLGLILLGRAAFVFPLSFLSNLTKKSQHQKISFRQQVIIWWAGLMRGAVSMALAYNQFTMSGHTQLRSNAIMITSTITVVLFSTVVFGLLTKPLIRLLLPHPKITSSMTTTESTTPKSFIVPLLGDSRDSEADLEGHEIHRPNSLRALLSTPTHTVHRLWRKFDDSFMRPVFGGRGFVPVEPGSPSERNGNQWG

SEQ ID NO: 15429 - protein, 211 aa, Carica papaya
MSYDYLFKYIIIGDTGVGKSCLLLQFTDKRFQPVHDLTIGVEFGARMVAIDGRPIKLQIRDTAGQESFRSITRSYYRGAAGALLVYDITRRETFNHLASWLEDARQHANPNMSIMLIGNKSDLSHRRAVSKEEGEQFAKEHGLLFLEASARTAQNVEEAFIRTAAKILQNIQEGVIDVSNESSGIKFGYGRPQGTAGARDGAVAQRSGCCG

SEQ ID NO: 15430 - protein, 516 aa, Arabidopsis thaliana
MANEEQGSILKALDVAKTQWYHVTAVVVSGMGFFTDSYDLFVISLITKLLGRIYYQVPGSSSPGSLPDGISAAVSGVAFAGTFIGQIFFGCLGDKLGRKRVYGLTLLIMTICSICSGLSLGRDPKTVMVTLCFFRFWLGFGIGGDYPLSATIMSEYSNKRTRGAFIAAVFGMQGIGILAAGAVSLLVSAVFESKFPSRAYILDGAASTVPQADYVWRIILMVGALPALLTYYWRMKMPETARYTALVSKNAEQAALDMTKVLNVDIEASAAKNDQARVSSDEFGLFSMKFLRRHGLHLLGTASTWFLLDIAFYSQNLFQKDIFTTIGWLPSAKTMNAIQELYMIAKAQTIIACCSTVPGYFFTVGFIDYMGRKKIQIMGFAMMTIFMLSLAIPYHHWTLPANRIGFVVLYSFTFFFSNFGPNATTFIVPAEIFPARIRSTCHGISAASGKAGAMVGSFGFSALVKALGMSNTLYIMAGINLLGLLLTFTIPETNGKSLEELSGETEPEKIKEKIVV

SEQ ID NO: 15431 - protein, 548 aa, Neurospora crassa
MVLGKKSIKINGADIGVEAILLGAVTAIGGFLFGYDTGQISGMLLFSDFKNRFGQITQPDGSKEFESIIQSLLVSLMSIGTLLGSLTSSYTATWWGRRKSLTFGVGLFIIGNIIQITAMHSWVHMMMGRFVAGLGVGTLSVGVPMFQSECSPREIRGAVVASYQLLITFGILIANIVNYGVREIQEQDASWRIVIGLGIFFSLPLGVGVLLVPESPRWLASKEDWEGARMSMARLRGLKHDPHNELVEDDMKEMREVLEKERTAAVGTWKECFIPNKNGVPKQVYRTFLGIGIHFLQQWTGVNYFFYYGATIFQSAGIKDPIQTQLILGAVNVFSTLFGLWVVERFGRRWPLFIGAIWQASWLAVFASMGTALEPDQNKASGIVMIVSAALFIASFACTWGPIAWVVIGESFPLRTRAKQASLATAGNWLGNFMISFLTPLATDGIGYAYGYVFVATNIMGALLVWFFLYESTSLSLENVDLMYSEPGIKPWNSHKWMPPGYITRMQRDDEYFHHPEKGGSDGLEITNGSKEMHPHEEREEKVINHRV

SEQ ID NO: 15432 - protein, 296 aa, Schizosaccharomyces pombe
MSAEIKGSTQVKAGLAQMLKGGVIMDVVNAEQARIAEAAGACAVMALERVPADIRAQGGVARMSDPSMIKEIQAAVSIPVMAKVRIGHFVEAQILESIGVDYIDESEVLTPADDINHIEKSKFTVPFVCGSRNLGEALRRISEGAAMIRTKGEAGTGDVVEAVRHTRQMQGELRRVKSMSPDELYTYAKEIAAPIDLVKECAQLGRLPVVNFAAGGVATPADAALMMQLGCDGVFVGSGIFLSGDPAKRARAIVRAVTHYNDPKILAEVSENLGAAMVGRSVSSLEEKEKLATRGW

SEQ ID NO: 15433 - protein, 62 aa, Daucus carota
WAMGTLGFEDYIEPLKVYLARYREMEGDTKRSGKGAEGSSRKEVYNRFIRDSLFIKVHIHRV

SEQ ID NO: 15434 - protein, 369 aa, Oryza sativa (japonica cultivar-group); identical to SEQ ID NO: 11247

SEQ ID NO: 15435 - protein, 417 aa, Ipomoea nil
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 15436 - protein, 429 aa, Bacteroides thetaiotaomicron VPI-5482
MKQEIKPATGRLGVLVVGVGGAVATTMIVGTLASRKGLAKPIGSITQLATMRMENNEEKLIKDVVPLTDLNDIVFGGWDIFPDNAYEAAMYAEVLKEKDLNGVKDELEAIKPMPAAFDHNWAKRLNGTHIKKAATRWEMVEQLRQDIRDFKAANNCERVVVLWAASTEIYIPLSDEHMSLAALEKAMKDNNTEVISPSMCYAYAAIAEDAPFVMGAPNLCVDTPAMWEFSKQKNVPISGKDFKSGQTLMKTVLAPMFKTRMLGVNGWFSTNILGNRDGEVLDDPDNFKTKEVSKLSVIDTIFEPEKYPDLYGDVYHKVRINYYPPRKDNKEAWDNIDIFGWMGYPMEIKVNFLCRDSILAAPIALDLVLFSDLAMRAGMCGIQTWLSFFCKSPMHDFEHQPEHDLFTQWRMVKQTLRNMIGEKEPDYLA

SEQ ID NO: 15437 - protein, 515 aa, Cryptococcus neoformans var. grubii
MFQKVSDKFHRKQQSSTSPGKTQQVPNSPSSVLAKANSQAQQAYSSQDHSPMEGIQSDSTHIQQPMATQKAPIVGPSTSTSLSTVPVQDGTLPLTPGAQGMLAGTTDGHRQVQSPVSRSSSAGEDKMREKARDAQEQAAQAQANLHRVTQQARVAAINAAATQAALETATQLPATARVPTSGTGAEPGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTDFGFAKYVPDITWTLCGTPDYLAPEVVQSKGYNKSVDWYALGVLIFEMLAGYPPFFTEDGNPMKLYEKIIAGKVRYPTYFDVLAKELLKNLLIGDLTKRYGNLRAGSSDIFAHGWFAEVDWDKLYRREIPAPYVPKIDGEGDASQFDRYQEADVSAYGKVGNGPYDHFFVEF

SEQ ID NO: 15438 - protein, 480 aa, Sarcothalia livida
QGIKNERYESGVIPYARMGYWDPDYVVKETDVLALFRVSPQPGVDPIEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENFNSQPFMRWKERFLYSMEGVNRAIAAAGETKGHYLNVTAATMEQMYERAEFAKQLGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGDDVVLQFGGGTIGHPDGIQAGATANRVALESIVIARNEGRDYVTEGPQILQDAAKTCGPLQTALDLWKDISFNYTSTDTADFVETPTANV

SEQ ID NO: 15439 - protein, 560 aa, Eschscholzia californica
MEKPILLQLQAGILGLLALICFLYYVIKVSLSTRNCNQLVKHPPEAAGSWPIVGHLPQLVGSGKPLFRVLGDMADKFGPIFMVRFGVYPTLVVSTWEMAKECFTSNDKFLASRPPSAASSYMTYDHAMFGFSFYGPYWREIRKISTLHLLSHRRLELLKHVPHTEIHNFIKGLFGIWKDHQKQQQPTGREDRDSVMLEMSQLFGYLTLNVVLSLVVGKRVCNYHADGHLDDGEEAGQGQKLHQTITDFFKLSGVSVASDALPLLGLFDLGGKKESMKRVAKEMDFFAERWLQDKKLSLSLSSETNNKQNDAGEGDGDDFMDVLMSILPDDDDSLFTKYSRDTVIKATSLSMVVAASDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNFATLILHMTLARLLQAFDLSTPSSSPVDMTEGSGLTMPKVTPLKVLLTPRLPLPLYDY

SEQ ID NO: 15440 - protein, 251 aa, Zea mays; identical to SEQ ID NO: 4945

SEQ ID NO: 15441 - protein, 228 aa, Zea mays
MSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDENIGKSKKILAAHKKILAAMSKRMDRNKWIIGGIITALALAILFILYFKLAH

SEQ ID NO: 15442 - protein, 355 aa, Spirulina platensis
MTQNYRITLLSGDGIGPEIMAVAVDVLKAVGKQLDLNFEFKEALMGGVAIDATGEPLPEESLQACRDSDAVLLAAIGGYKWDNLPRPERPETGLLALRAGLGLFANRARLLFCPHVLDASSLKREVVEGVDIMVVRELTGGIYFGQPKGIFETETGKNEGSNTMAYGESEIDRIGRVGFETAKKRQGRLCSVDKANVLDVSQLWRDRIMALAADYPEVELSHLYVDNAAMQLVRWPKQFDTIVTGNLFGDILSDAAAMLTGSIGMLPSASLGASGPGVFEPVHGSAPDIAGQDKANPLAQVLSAAMMLRYGLDEPAASDPVEKAVLKVLDWGYPTGDIMSEGMKAVGCRKWGICY

SEQ ID NO: 15443 - protein, 197 aa, Sulfolobus acidocaldarius
MIPDEIPYKAVVNIENIVATVTLDQTLDLYAMERSVPNVEYDPDQFPGLIFRLESPKITSLIFKSGKMVVTGAKSTDELIKAVKRIIKTLKKYGMQLTGKPKIQIQNIVASANLHVIVNLDKAAFLLENNMYEPEQFPGLIYRMDEPRVVLLIFSSGKMVITGAKREDEVHKAVKKIFDKLVELDCVKPVEEEELEF

SEQ ID NO: 15444 - protein, 132 aa, Zea mays
  unsure (1)..(132): unsure at all Xaa locations
MASRKCLGGEGSAPAPHVLAVDDSSVDRAVIAGILRSSQFRVTAVDSGKRALELLGTEPNVSMIITDYWMPEMTGYELLKKIXRLKEIPVVIMSSENVPTRINRCLEEGAEDFLLKPVRPSDVSRLCSRVLR

SEQ ID NO: 15445 - protein, 153 aa, Zea mays
  unsure (1)..(153): unsure at all Xaa locations
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSHIDCGVSIGTIFGIYMVKDXDXVTLG

SEQ ID NO: 15446 - protein, 120 aa, Triticum aestivum
  unsure (1)..(120): unsure at all Xaa locations
MARRPLVLLALLAMTLAVASAVLGAHGARVGGWGPIPDVRDAHIQELGGWAVXQHARLASDGLRFRRVTRGEQQVVSGMNYRLFVDAADGSGKSAPYVAEVYEQSWTNTRQLTSFKPAAN

SEQ ID NO: 15447 - protein, 328 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVQTAAAATATTTGTGGTERWGPLRPSYLVRFCYRVHPSLEGVYLRLWSSRVRMFRFVFVVVVAHLCF

SEQ ID NO: 15448 - protein, 355 aa, Corchorus capsularis
MGSLETERKIVGWAATDSTGHLAPYTYSLRDTGPEDVDIKVISCGVCHTDIHQIKKDLGMSHYPMVPGHEVVGEVVEVGSDVTKFNVGDVVGVGVIVGCKNCHPCKSEIEQYCNKKIWSYSDVYTDGKPTQGGFAASMVVDQKFVVKIPDGMAAEQVAPLLCAGVTVYSPLKHFGLMESGLRGGILGLGGVGHMGVKIAKAMGHVTVISSSDKKREEAMEHLGADEYLVSSDVESMQKAADQLDYIIDTVPVVHPLEPYLSLLKLDGKLILMGVINAPLQFVSPMVMLGRKSITGSFIGSMKETEEMLEFCKEKGLASMIEVIKMDYINTAFERLEKNDVRYRFVVDVAGSKLIP

SEQ ID NO: 15449 - protein, 178 aa, Glycine max
  unsure (1)..(178): unsure at all Xaa locations
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 15450 - protein, 474 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 15451 - protein, 275 aa, Xanthomonas axonopodis pv. citri str. 306
MTHLSFEFYPPKTDDQRAQLDRTAARLKGYAPEYVSCTFGAGGSTLSYTSETVRHLKQKHGFEAAPHLSCVGGSRQEIRELLKLYRAIGCTRIVALRGDLPSGMGHPGDLRYASDLIAFIRAEHGDAFRIEVGAYPETHPQAADALSDLRYFKAKVDAGADAAITQYFYNADAYFHFRDAVQRMGVEIPIIPGIMPISNFSQLRRFSEQCGAEIPRWIGKKMQSYGDDADAVRAFGAEVVAALCERLIAGGAPALHFYTLNLAKPTTQVLQLLGR

SEQ ID NO: 15452 - protein, 465 aa, Oryza sativa
MAASPAAGAAAATVSSFVSPSFFSSVKASKPDRLRPARRAAAVNVRCVSSPPATETSFKTKVPRNANMAKLQAGYLFPEIARRRAAHLLKFPDAKIISLGIGDTTEPIPDVITNAMAKDGAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 15453 - protein, 449 aa, Sargassum muticum
DILALFRITPQPGVDPVEAAAAVAGESSTATWTVVWTDLLTACDIYRAKAYRVDPVPGTNDQYFSYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATMENMYERAEYSHAIGSVICMIDLVVGYTAIQTMAIWARKAEMILHLHRAGNSTYARQKNHGINFRVICKWMRMSGVDHIHAGTVVGKLEGDPLMVRGFYNTLLLTELKINLAEGLFFDMDWASLRKCVPVASGGIHCGQMHQLLYYLGDDVVLQFGGGTIGHPDGIQAGATANRVALEAMVLARNEGRDYVGEGPEILRTAASTCGPLKAALDLWKDITFEYTSTDTPDFVEVATEN

SEQ ID NO: 15454 - protein, 382 aa, GIBBERELLA ZEAE PH-1
MSQIKTFRILVLPGDHVGPEIMTEALKVLDVIEASRPDIHFERDVDICGGCSIDKYGTPITESVLEKAVASDAVLFGSIGGPEWAGAEPTPESGLLRLRQRLDAFANLRPCEILVPSLVSASPIKPELVAGTKFIVVRENCGGAYFGKKEESEDEASDLWIYSRSEVERLARVSAAVARILHAGSEKANNGSKPVVWSADKANVLASGRLWRRATTNIFNRELTDIDLKHQLADSLAMLMVLDPKRFNNSVIHTDNTFGDVLSDISGGITGTLGVLPSASLAGVPGEGSCKGIYEPVHGSAPDISGKNLANPVAQILSLAMMLRYSFLLEKEADAIEQAVAKVLDTKDGGGLEIRTKDLGGSAMCSEVGDAVCKVLGDMLET

SEQ ID NO: 15455 - protein, 148 aa, Listeria monocytogenes
IMYLFSDEGTPASYREIRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGM

SEQ ID NO: 15456 - protein, 360 aa, Lolium perenne
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGTLVDVGGGVGATVAAIAAHYPTIKGVNFDLPHVISEAPQFPGVTHVGGDMFKEVPSGDTILMKWILHDWSDQHCATLLKNCYDALPAHGKVVLVQCILPVNPEANPSSQGVFHVDMIMLAHNPGGRERYEREFQALARGAGFTGVKSTYIYANAWAIEFTK

SEQ ID NO: 15457 - protein, 546 aa, Zea mays
MARRAASSLVSRCLLARAPAGAPPAAPSAPRRTDGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 15458 - protein, 373 aa, Zea mays
LLSFWANIFSIKINPSLFSLLGAILILKVDCRDKLKEEETEECCHGHYTYGDLGDRCFGTIGRCLTETLVLVSQAGGSVAYLIFIGQNLHSTFSQLMSPAGFIFAILLPLQIALSFIRSLSSLSPFSIFADVCNVLAMAIVIKEDLQLFDHPFSNRSAFNGLWAVPFTFGVAVFCFEGFSMTLALEASMADRRKFRSVLSQAVAAIIAVYVCFGVCGYLAYGEATKDIITLNLPNNWSSAAVKVGLCIALAFTFPVMMHPIHEIVETRFRSNRCFRKLSHNDGGAEWIGLHASRVLVVAVLTVVASFIPFFGSFISFVGSTMCALLSFVLPALFHLSIVGSSIPLWRRVLDYGILLFGLAFAGYGLVTALSSH

SEQ ID NO: 15459 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEGARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 15460 - protein, 152 aa, Yersinia enterocolitica
GINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVKRTT

SEQ ID NO: 15461 - protein, 288 aa, Arabidopsis thaliana
MKSRLKSYRRKKLGLATVIVFCSLCFLFGFYGSTLLSQNVPRVKPRLRMLDMVENGEEEASSMPHGVTGEESIGSIPFQVLSWRPRAIYFPNFATAEQCQAIIERAKVNLKPSALALRKGETAENTKGTRTSSGTFISASEESTGALDFVERKIARATMIPRSHGESFNILRYELGQKYDSHYDVFNPTEYGPQSSQRIASFLLYLSDVEEGGETMFPFENGSNMGIGYDYKQCIGLKVKPRKGDGLLFYSVFPNGTIDQTSLHGSCPVTKGEKWVATKWIRDQDQEE

SEQ ID NO: 15462 - protein, 860 aa, Oryza sativa
MVRSTCCVVLLLLLSVAARSASAIMDGLLPNGNFEEAPDKSQLNGTRVIGRYAIPQWEISGFVEYIGSGQMQGDMLLPVPEGAYAVRLGNEASIQQRLTLTRGMHYSVTFSAARTCAQSELLNITVTPEIGEVPIQTVYTSSGWDSYSWAFKARRSDVSLIVHNPGVTDDAACGPLIDSFAIKTLQSPPSTKDNLLKNGGFEEGPYIFPNTSWGVLVPPMDEDDYSPLSPWTIMGYTKSVKYVDAAHYAVPGGARAVELVAGMEAALVQEVCTVPGRSYRLEFSVGDAGDGCVGSMSVQAYVSHGSVKVPYESQGRGGYKRGVLEFTATDKRTRVVFVSMAYTMKPDGTLCGPVVDDASVVGVHSHRRLLLEQLVVERLSPEDRHMTTPAMGHGPVETGAESSIRGGMPPAALQVPSWQDVAIRIASKQRAEARIPPVLLVTHAPARARVGVTCHASMPCPAFKWTVLQRVGRREQPRARDSREGSHGMTGSARSVVALLFLLVGSAARADSAVTDGLLPNGNFEDGPDKSQLNGTVVTGRYAILNWEISGFVEYIESGHREQDMILAVPEGARAVRLGNDATIRQRLSVTRRAYYSITFSAARTCAQKEKLNMSVTPEFGVLPIQTVYTSSGWDSYSWAFRAKHSVVWLSIHNPGEEEDPACGPLIDSIAIKNLYPPPRTKGNMLRNGDLEEGPYIFPDATWGVLVPPIFEDEHSPLPGWMIMSDTKVIKYVDSPHHRVPQGARAVELVAGRETALVQEVATVPGRSYRLSFSVGDAGNGCKDSLAVEAYAARATAKVPYESQGTGGHKRAQLEFAAVANLTRVVFQSFNYHTKPDGTLCGPLVDDISLVSVRKRAARL

SEQ ID NO: 15463 - protein, 493 aa, Bradyrhizobium japonicum USDA 110
MTKAEIRFPLDGRARKMFVDGAWVEARSGKVFETRNPATGEVIGRVPRGEAADISVAVAAARRAFVGPWSRFKPFERQALLLRIADLFEKHWEEISQSDTADMGMPIARTRANKLRVIGMLRYYAGMATALHGQTVDNSLPGDIVSFTRKEPIGVVGAIIPWNAPTAASVWKIGPALATGCTIVLKPSEEAPLTPLLIADLMNEAGVPPGVVNVVTGTGVEAGAPLAEHPDVDKIVFTGSTATGQAIIRASAGNLKRVSLELGGKSPVIVCADADLDKAVPIAAMAAFANSGQICIAGSRLFVERKIHDELVERLGKFASALKIGDGADPTTEIGPLVSQRQLDKVEGFLQSGREEGAKVVAGGRRVREGNLAKGNFVEPTVFAGVSDDMQIARDEIFGPVISALPFDTLDEAVERANATPYGLAAGVFTRDVSKAHVISRSLRAGSVWVNTYHALDPAMPFGGYKMSGYGREGGTEHLDEYLHTKGVWIKLD

SEQ ID NO: 15464 - protein, 395 aa, Pyrococcus furiosus DSM 3638
MEFKRLTPYEEALSIVLNDLKEIEEVEYVPLKDALGRVLAEDIVASYDLPPFDRAAVDGYAVRAEDTFEAREYSPVELEVIEEVPIGENPNKEVIAGKAIKVLTGGKIPRGANAVIMQEMVKREGSKIYVLRPVAPGQNISFAGEDVKKGDIALKKGTILRPQDLALLKALGIRKVPVKVKPKVGIIITGSELVQEPSLEEFEKGKIVDTNSIMLSALVERYFGEPILYGVVPDNEDLIRSALEKAKRECDLVLITGGSAFGDMDYAHKFVNLLFHGTTIRPGRPIGYGERVFVMSGYPVAVFTQFHLFVKHALAKLVGAKDYEVKVRAVLEDDVPSQLGRYEFVRVMYRDGKAKVIKKKGSGIISSLVQSNAYLVVPEDVEGYRRGEEVWVTLY

SEQ ID NO: 15465 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHGRASPETMRDIRGFAVKFYTREGNFDLVGNNTPVFFIRDGIQFPDVVHALKPNRKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEARLTHEIRGIWTSYWLKADRSLGQKLASRLNVRPSM

SEQ ID NO: 15466 - protein, 206 aa, Peperomia caperata
SVLCDAEVAVIVFSTKGKLYEYATDAGMARILDRYEKHTFSNRELELTNLESEGAWSLEYGKLKARFELLQKSHRHYLGEDLGALNMKELQHIEHQLDSALRHVRSRKNQILSDTISDLQTKEKLIHEQNKILQKRIQEKEREITGQPQWEIVPSRQENQNPQPTLFPIPLHTLSIGYCKEDGKAIELGLENEPRPLSQKMPPWML

SEQ ID NO: 15467 - protein, 436 aa, Nostoc sp. PCC 7120
MQNKLSCEVKRNPHTPKPLHPYTPMPSVRDTANIIFNLVPKLDSQQDTEIVDLWAANGRILATPVNSTLDFPHWDNSAMDGYAVRYEDVHNSNAEQPVSLEVVAEIPAGYQPKFTLQPGQAARIFTGAVMPSGGDTVVMQEKTRQENNRVFILTTPKPGEFVRLKAAYYQAGTQLLPANTQLNAAEIAILAASQCPQVKVYRRPRVAIFSTGDELVTLDQPLQPGQIVDSNQYALAALVKQNGAEPILFGIVKDNPTALGETISKAIANADIVISSGGVSVGDYDYVDQILASLGAKIHIRSVEMRPGKPLTVATFPTPPAPIYLGLPGNPAAVLVTFWRFVQPVIRKLGGLAKGWEPVFVKVRSHDELHSDGKRETYIWGSLHLVDGLYEFHKAGGSHSSGNLINLAQTNALAVLPLGETFISSGKDVLVLQLPI

SEQ ID NO: 15468 - protein, 427 aa, Batrachospermum turfosum
IEAAAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYNTLLLSHLDINLPQGIFFEQDWASLRKVTPVASGGIHCGQMHQLLDYLGDDVVLQFGGGTIGHPDGIQAGATANRVALESMVMARNEGRDYVNEGPQILKEAAKTCGPLQTALDLWKDISFNYTSTDTADFV

SEQ ID NO: 15469 - protein, 357 aa, Prochlorococcus marinus subsp. marinus str. CCMP1375
MALVPLRLLLDHAAENGYGIPAFNVNNLEQVQAIMEAASETDSPVILQASRGARTYAGEIFLRHLIIAATETYPNIPVVMHQDHGNDPSTCYSAAINGFTSVMMDGSLEADAKTPSSYEYNVAVTKKVVDFAHSVGVSVEGELGCLGSLETGKGEAEDGHGFEGELSKDMLLTDPSEASDFVAKTKVDALAIAIGTSHGAYKFTRKPTGEVLAISRIAEIHKAIPNTHLVMHGSSSVPQEWLDMINKFGGAIPETYGVPVEEIQEGIRNGVRKVNIDTDNRLAFTAAVREAAAADPTNFDPRHFNKPARKYMKQVCLDRYQQFWCAGQASKIKQESTNYYSGLYAKGTLDPKAAVAV

SEQ ID NO: 15470 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 15471 - protein, 213 aa, Azorhizobium caulinodans
MKGIILAGGSGTRLHPITLVVSKQLLPVYDKPMIYYPLCTLMMAGIRDILIITTPHDSELFQKLLKDGSQFGLNISYAVQPSPRGLADAFIVGREFVGNDRVALVLGDNLFFGHGLPELLKTAQARETGATVFGYPVTDPERYGVVEMDETGKVLSLEEKPLKPKSNLAVTGLYFYDNRVVDIAANLAPSPRGEIEITDVNKAYLDLGELEFT

SEQ ID NO: 15472 - protein, 288 aa, Arabidopsis thaliana
MDSQYFLAFSLSLLLIFSQISSFSFSVDPTRITQLSWTPRAFLYKGFLSDEECDHLIKLAKGKLEKSMVVADVDSGESEDSEVRTSSGMFLTKRQDDIVANVEAKLAAWTFLPEENGEALQILHYENGQKYDPHFDYFYDKKALELGGHRIATVLMYLSNVTKGGETVFPNWKGKTPQLKDDSWSKCAKQGYAVKPRKGDALLFFNLHLNGTTDPNSLHGSCPVIEGEKWSATRWIHVRSFGKKKLVCVDDHESCQEWADAGECEKNPMYMVGSETSLGFCRKSCKAC

SEQ ID NO: 15473 - protein, 166 aa, Zea mays
MDAVMFGLETPLMAALQHLLDVPDGDAGAGGDSDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 15474 - protein, 555 aa, Atriplex dimorphostegia
MWSQLSSLLSEKMDALATSDHASVVSMNLFVALLCGCIVIGHLLEENRWMNESITALLIGLSTGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVANDATSVVLFNAIQSFDLTRIDHRIALQFMGNFSYLFIASTILGAFTGLLSAYVIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNLAKKSHGEKVTFNQQIVIWWAGLMRGAVSMALAYNQFTRSGHTQLRGNAIMITSTISVVLFSTMVFGLLTKPLIMFLLPHPKHFTSCSTVSDVGSPKSYSLPLLEGNQDYEVDVGNGNHEETTEQRTIVRPSSLRMLLNAPTHTVHHYWRKFDDSFMRPVFGGRGFVPFVPGSPTEQSTNNLVDGT

SEQ ID NO: 15475 - protein, 199 aa, Vibrio vulnificus CMCP6
MNTKPSTYSNGCLGRDILHILSSPCVQESVKEIGAMCGLIERINKGGVMLTWQDIITFTHQGNPQPDTVVRKSDAQWREQLGEAQYYVMRQHGTERPFSNQMCELFEPGLYRCAGCQNLLFDSGSKFDSRTGWPSFAQPMKSNAISYHLDETLARPRIEVRCNQCESHLGHVFPDGPAPSGLRYCVNAVSIEKVNQEAS

SEQ ID NO: 15476 - protein, 480 aa, Halobacterium sp. NRC-1
MEQNAIQRRERPFVAGEWVSDGEPLPVSDLADGGTFASVAAADTSDAERALSAATGVHADLRETTVPERVEWLESIADGIRRREDELAEVIVREAGKPISSARGEVQSAAERFDRAVGELRHLTGEYRTGTTAGHEDWQAIVKHEPMGTVLCITPYNYPLSTMALQVAPAIAAGNAVIVKPASKTPISGAILADIAADAGLPDGAYNFVPGESSVIGDPLASDARVDAIAMTGSSGAGEHVARQSGITRLHMELGGNAPAIVFEDADLDAAADAATAGSLKYAGQRCSAVSRVLAHESVHDELVSRIDDAMAEWSIGDLFDTDTTLGPLVSADQADWVAELVDDAVDRGATVVRGGERHVEDGVHYYEPTLLADVPRDARIVDEEQFGPVCAVTTVTDEDDAVRTANGSELALDAAVFTADHDRAMRVAERVNAGAVRINGAPSHGLGDVPFGGNDASGIGREGLDSTIHEFVREKSIIL

SEQ ID NO: 15477 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARLNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 15478 - protein, 119 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFNEQEVADLTKRIQNAGTEVV

SEQ ID NO: 15479 - protein, 365 aa, Pseudomonas putida
MPAHSFRIAAIPGDGIGLEVLPEGIRVLEAAALKHGLALEFDTFEWASCDYYLQHGKMMPDDWAEQLKQYDAIYFGAVDWPDKVPDHISLWGSLLKFRREFDQYVNIRPVRLFPGVPCALANRKVGDIDFVVVRENTEGEYSSLGGIMFENTENEIVIQESIFTRRGVDRILKYAFDLAEKRERKHVTSATKSNGMAISMPYWDKRTEAMAAHYPHVSWDKQHIDILCARFVLQPERFDVVVVASNLFGDILSDLGPACAGTIGIAPSANLNPERNFPSLFEPVHGSAPDIFGKNIANPIAMIWSGALMLEFLGQGDERYQRAHDDMLNAIERVIADGSVTPDMGGTLSTQQVGAAISDTLARLD

SEQ ID NO: 15480 - protein, 750 aa, Halobacterium sp. NRC-1
MGLDDDALDYHASDPPGKVEISTTKPTNTQRDLSLAYSPGVAAPCRAIADDPTEAFTHTTKGNMVGVVSNGSAVLGLGDIGAQAAKPVMEGKGVLFKRFADIDVFDIELDQATADELVATVSAMEPTFGGINLEDIKAPECFEVERRLGDAMDVPVFHDDQHGTAIISGAALLNAAEIAGKDLSDLDVVFSGAGASAIATAKFYVSLGVDREHITMCDSSGVITEDRDVNEFKAAFAQPADSGGDLADAMAGADVFVGLSVGGIVNQAMVRSMADDPIVFAMANPDPEIDYESAKAAREDTVIMATGRSDYPNQVNNVLGFPFIFRGALDVRATDINEEMKVAAATALADLAKQDVPDEVVKAYGDQPLQFGSEYIIPKPLDPRVLFEVAPAVADAAMETGVARTELDLVDYREELEARLGKSREMMRIVINKAKSEQQRIALGEGGDEKMIRAAHQMHEAGIADPVLLGDRDTIQGTVDALSLDFDPDVVDPDEGDHSAYADTLYDLRKRKGITRNEAESLVARDPNYLGSTMVEAGDADAFLTGLTHHYPSALKPPLQVVGTAPDTDYVAGVYMLTFQNRVVFCADATVNQDPDADVLAEVAQHTADLARRFNVDPRVAVLSYSNFGSVDNEGTRKPRRAAQQLREDDDIDFPVDGEMQADTAVVEDILQGSYEFSDLDTAANVLIFPNLEAGNIGYKLLQRLGGADAIGPMLVGMNKPVHVLQRGDEVKDIVNLAAVAAADAQQRED

SEQ ID NO: 15481 - protein, 246 aa, Triticum aestivum
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKARVDNLQRTQRNLLGEDLDSLGIKELESLEKQLDSSLKHIRTTRTQHMVDQLTELQRREQMFSEANKCLRIKLEESNQVHGQQLWEHNNNVLGYERQPEVQPPMHGGNGFFHPLDAAGEPTLHIGYPPESMSNSCMTTFMPPWLP

SEQ ID NO: 15482 - protein, 359 aa, Streptomyces coelicolor A3(2)
MSETSPKLRAELEGIPTYKPGKPAAADGPVAYKLSSNENPYPPLPGVMETVTAAAASFNRYPDMACTSLMAELSDRFGVPLAHLATGTGSVGVAQQLIQATSGPGDEVIYAWRSFEAYPIITQISGARSVQVPLTPGEVHDLDAMADAITDRTRLIFVCNPNNPTGTVVRRAELERFLDRVPSDVLVVLDEAYREFIRDAEVPDGVEFYRERPNVCVLRTFSKAYGLAGLRVGFAIAHEPVAAALRKTAVPFGVSQIAQEAAIASLRAEDELIGRVGSLVCERARVADALRAQGWTVPESQANFVWLRLGERTLAFANACEQAGVVVRPFAGEGVRVTVGESEANDIFLKVSEEFRKEL

SEQ ID NO: 15483 - protein, 66 aa, Brassica napus
IVSKYPDLKGINFDLPHVIEEATSHPGIDHVGGDMFVSVPKGDAIFMKWICHDWSDEHCVKFLKNC

SEQ ID NO: 15484 - protein, 116 aa, Prochlorococcus marinus subsp. pastoris str. CCMP1378
MAGFGLPNFGQLTEAFKKAKEIQQNAQKLQDELESMEIEGKSDDEMIKVWISGNQLPLRVEVNENISTANKEEIEKNILEAIKKAHESSTTTMKERMNDLTGGLNLNLPGLDNNDS

SEQ ID NO: 15485 - protein, 144 aa, Escherichia coli
AYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 15486 - protein, 2426 aa, Aspergillus fumigatus
MGWRLVGSLLAFFAATSIAWPYDEALVDYNLNTNKQASNPAEYSTDGPGHKYTPSPDNWRFPMYTLFLDRFVNGDPTNDNINGTLFEHDLNSNQMRHGGDVVGLIDTLDYLQGMGIKGIYLAGTILLNQPWGSDGYSTLDTTLLDHHFGNIQSWRDAISEIHRRGMYVVFDNTIATMGDLIGFEGYLNTTTPFSVKEHKALWKTDRHYVDFHFGNDYNETCDYPRFWNETGWPVDQSVRDQLNGCYDSDFDQYGDREAFGVYPDWQRQLAKFASVQDRLREWNPSVRQRLTRHSCMIIEALDIDGFRYDKATQATVDALGEMSLAYRECARKVGKNNFFISGEITGGNTFGSIYLGRGRQPNQYLKSAIDAMNMTNLSDHQYFLREHGHEAIDAAAFHYSIYRSLTRFLGLDGNLAAGYDTPVDWTDAWNLMVISNDMINANTGKFDPRHMYGATNQDVFRWPAIEYGVERQLLALFITTLHLPGIPLLLWGEEQAFYILDATASNYIYGRQAMSPATAWKTHGCFQLTPSQYYNWPIQKGRQGCHDETATYDHRDPSHPVRNIIKHMYQMRENYLVLNDGWWLQKLSKQTREIYLPGSNSTPTETGMWSILRGVTPGIQSLGSDKDDQPVWLVYQNENHTVDYKFDCGSNDSALVAPFASGTTVRNLFYPHDEHVLKDGPKKLGLNGSSDTNGCLDSLTLKPFEFRAYVPKNRFIAPRPMITQITPGHDTPLLSKVAPDQAEEIDVSIYFSAEMDCDSVTKSITLNSTTESGKTPSVDSKSASCRKIPATDTQWTGQLPNVWVWTGKLTGVYNGIHRLTVTNASDSAGTSATNAIDHFLFRVGQSDNPMVFTSANYSSSLLHEHENGTLFIQHHAAGADKYRYSTNWGSSFSDWMDYKGGNETIEELPWSGTKKQKWQGKHVRVEYWSKLTGSSDYVQEGDSGWDSNRPRRFPHLFFNGPYNQYGYDAGLDNAVQLGDDGLWRFRFVAEWPAQGQFNVWGINPDGQPDQSFVFGDADMDGVLDRMPPSSLSTTLINITDHPPAPHLAWVLHLDDSALQFQLEPTGSRAAQMAAFFLLWLIPVLTAAACVYGFKKSFYQVKFNQVGVSEKKKLLPLWLRRKIKRADLEDGEPMNPLVRFANRSSFVQSRSAFNEGTLKRRTVLIATMEYDIEDWAIKIKIGGLGVMAQLMGKNLGHQNLIWVVPCVGGVDYPEDQRADPMFVTVLGNSYEVNVQYHVIKNITYVLLDAPVFRQQTKTEPYPARMDDLDSAIYYSAWNQCIAQAIRRFSVELYHVNDYHGSIAPLYLLPQTIPICLSLHNAEFQGLWPMRTQKEKDEVCSVFNLDLDVASRYVQFGEVFNMLHAGASYLRLHQQGFGAVGVSKKYGKRSYARYPIFWGLKKVGNLPNPDPTDTGEWNGEPTRQSDIKVDAAYEASRGEFKRQAQEWAGLEQNPNADLLVFVGRWSMQKGIDLIADVMPAVLEARSNVQLICVGPVIDLYGKFAALKLDRMMELYPGRVFSRPEFTALPPFIFSGADFALIPSRDEPFGLVAVEFGRKGALGIGARVGGLGQMPGWWYNVESTTTSHLLHQFKLAIGSALDSKPKVRAIMRARSAKQRFPVAQWVEDLEILQSTAIRIHSKELAKSSGQTLTPSGCNTPSGTMTPPVAGNLTPTGIQTPPLMHSREPSVSNASRLSVLGPQQRNTIVYSRDPSPGMIEKPKSGLSRQLSLGVRAGPGHLERRGRRKLKKMNQAGSDDNQNSTTDVESSSDDDIIPSYYGDDEYTLTPEQAEAGRQTEISQQQGHHSVWTPRDFFSQRHSSQTSISFNTPLSPTSTGVTEADDAIFPPARRMLEPANPSHRLSSASVLSVDSIVGAKRDYRLQRVDPFFTDSTGEFYRIFEKKLETLNGSNSESQLCIEEYLVKSEKKWFNRFRDARLGRNQSPASSVFRIKRDYSPNDTVSNEMGARESDSDPPKERDEFFLGSDYVPPTGLKKWMQVRIGDWPIYSIFLGLGQIIAANSYQITLLTGEVGQTPEKLYGIATTYLITSIIWWFFFRYFKSVVVLSLPWLLYGLAFVIIGVAHFESNSFSRGWIQNVGSGLYAAAASSGSIFFALNFGDENGVPVKQWVFRACVIQGTQQAYVIGLWYWGTSLAQASNSGIINPQGDITNTWRITAICLPIAIILWSVGLLVFFGLPNYYRQIPGKVPSFYKSVFRRKIVLWNFVVVIVQNFFLSAQYGRNWSFLWSSKNAEAWQVGILCAFFFGAVWAALLYLFGYLSKSHSWIIPVFACGLGAPRWAQVLWGVSGIGLYVPWAGGDLAGALVSRSLWLWLGVLDSLQGLGFGMILLQTLTRMHICFTLLASQVLGSIATICARAFAPNNIGPGPISPDLTAGVSSVANAWFWIAIFFQLLICAGFLRFFRKEQLSKP

SEQ ID NO: 15487 - protein, 185 aa, Pseudomonas aeruginosa UCBPP-PA14
MSHLATSTFQPLNIAILTVSDTRTLETDTSGQTLADALLAAGHRLHQRSLKSDDIYQIRAVVSAWIADPEVQVGLITGGTGFTARDNTPQAVGPLFERDVEGFGELFRQVSQREIGTSTIQSRALAGLSNGTLVCCLPGSPGACRTAWNEILLAQLDSRTRPCNFVPHLKTPPAVAPVAGCGCRS

SEQ ID NO: 15488 - protein, 501 aa, Glycine max
MTSLTNGDAGSLNKVPTIKFTKLFINGDFVDSLSGKTFETIDPRTGDVIARISEGDKEDIDIAVKAARHAFDNGPWPRLPGSERARILLKWAEIIEENAEELAALDAIDAGKLYHMCRNVEVPAAANTLRYYAGAADKIHGEVLKMSREFHAYTLLEPLGVVGHITPWNFPNTMFYIKVAPSLAAGCTMVLKPAEQTPLSALFSAHLAKLAGIPDGVINVVPGFGPTAGAALSSHMDVDKVSFTGSTQTGRVIMQAAAKSNLKQVSLELGGKSPLIIFDDADIDKATELALLGILYNKGEVCVASSRVFVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTIEEAIKSANNTKYGLAAGIVTKNLDTANTVSRSIRAGTIWINCYFAFGDDVPFGGYKVSGFGKDHGLEALHKYLQVKSVVTPLYNSPWL

SEQ ID NO: 15489 - protein, 413 aa, Bradyrhizobium japonicum USDA 110
MPGAQRAMEEFYRIRRLPPYVFEQVNRAKAAARNAGADIIDLGMGNPDLPAPPHVLEKLKETLGKPRTDRYSASRGIPGLRRAQAGYYARRFGVKLNPDTQVVATLGSKEGFANVAQAITAPGDVILCPNPSYPIHAFGFLMAGGVIRSVPSEPTPQFFEAVERAIVHSIPKPLALVVCYPSNPTAYVASLDFYKDLVAFAKKHEILILSDLAYAEVYFDENNPPPSVLQVPGAMDVTVEFTSMSKTYSMAGWRMGFAVGNERVIAALARVKSYLDYGAFTPVQVAATAALNGPDDCIKEMRDTYRKRRDALVESFGRAGWEIPPPEASMFAWVPLPEAFRSVGSMQFATLMVEKSGVAVSPGVGFGEHGEGYVRIAMVENEQRIRQAARGVRRFLESGIETLHNVVPLANRR

SEQ ID NO: 15490 - protein, 200 aa, Zea mays
CRKGGSIAQGIKEHGNITLLFHDGSEWNKFAVWKEAEAFFFATLTLGPNLSDTVKGKFSLVAKIVRAGGVEKVFRRWFSADKNEKLLQASQCHLSTTAGPIAGVLFVSTARVAFRSDRALAVPVPVPTPRGGTARVPYKVAIPLRKVRAVRPSENKHRPEQKYVRLATTDGFEFWFMGFVSYDKSLQHLERAVAYAQQAQ

SEQ ID NO: 15491 - protein, 405 aa, Geobacter metallireducens
MPSFTEARNIILDRVTPLGIERVGILEAAGRVLAEDVVAPWEMPLCDNSAMDGFAVRAADCATIPAALKVTGYIPAGGEVTGAVESGCAIRIMTGAPLPPGCDAVVPVEETEDDGAAIRVVAPVKERQHIRFKGEDVATGETVIPAGTLIQPPEVSMLASFGKALVPVFRKARVAILSTGDELVELGEPPVPGKIINSNTLSLAAAVRQCGAEPIVIGIARDNRESHREKLAEGLKADALITSAGVSAGDRDLVRDVLAEMGVEQIFWKVDMKPGGPTAFGMHGAKPVFSLPGNPVSTMVTFELFARPALLRMMGHRRVVRPFVKAILREDAKKKPGKVNFLRVQVTVQEGRFVASTAGDQHTGILRTMVRANGLALLPLEASIVHAGSEVDLMLLRDDVTMLER

SEQ ID NO: 15492 - protein, 375 aa, Saccharomyces cerevisiae
MLRTSTLFTKRVQPSLFSRNILRLQSTAAIPKTQKGVIFYENKGNLHYKDIPVPEPKPNEILINVKYSGVCHTDLHAWHGDWPLPVKLPLVGGHEGAGVVVKLGSNVKGWKVGDLAGIKWLNGSCMTCEFCESGHESNCPDADLSGYTHDGSFQQFATADAIQAAKIQQGTDLAEVAPILCAGVTVYKALKEADLKAGDWVAISGAAGGLGSLAVQYATAMGYRVLGIDAGEEKEKLFKKLGGEVFIDFTKTKNMVSDIQEATKGGPHGVINVSVSEAAISLSTEYVRPCGTVVLVGLPANAYVKSEVFSHVVKSINIKGSYVGNRADTREALDFFSRGLIKSPIKIVGLSELPKVYDLMEKGKILGRYVVDTSK

SEQ ID NO: 15493 - protein, 448 aa, Oryza sativa
MGQGTPGGMGKQGGAPGDRKPGGDGDKKDRKFEPSAAPSRVGRKQRKQKGPEAAARLPNVAPLSKCRLRLLKLERVKDYLLMEEEFVAAQERLRPTEDKTEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 15494 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTSQVTEAVCNAIAGSNII

SEQ ID NO: 15495 - protein, 427 aa, Neurospora crassa
MFRTSLRRAAAFQPARPCFGAFSATAARQYSAATGTADINPSKLKVEKTTQPKGLLKPEELVFGRNFTGTVQNLPSKNAQSALTNFRATPDHMLTIEWTKENGWNAPEIKPYQNLSLDPATCVFHYAFECFEGMKAYKDKAGKIRLFRPDKNMARFNKSAARIALPTFDSPALIDLIAKLVKLDSRFIPEQRGYSLYLRPTMIGTQKTLGVGPPGSALLYVIASPVGPYYPTGFKAVSLEATDYAVRAWPGGVGDKKLGANYAPCIVPQVEAMSRGFQQNLWLFGEEEYVTEVGTMNFFVAIKDKKTGQKTLVTAPLDGTILEGVTRDSVLALAREKLAPEGWKIEERKFTMKELAEAANEGRLIEAFGAGTAAIVSPVRSISWKGQLVNCGLKPEEESGELTMQVKNWMEARQYGDEEHEWSYVCE

SEQ ID NO: 15496 - protein, 343 aa, Anabaena variabilis
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 15497 - protein, 449 aa, Streptococcus agalactiae
MTITAEDIRREVKEKNVTFLRLMFTDILGVMKNVEIPATDEQLDKVLSNKAMFDGSSIEAFVRINESDMYLYPDLDTWIVFPWGDENGAVAGLICDIYNAEGEPFCRRFHVKFQRNMKRMNRVGYNSFNFRTRPDFLLFKLMKCNQHLIDCYCPRRPTLTLAPTDLANNNRREIVSLNTNWALKLKLVIMKLAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 15498 - protein, 292 aa, Vibrio parahaemolyticus RIMD 2210633
MIKKCLFPAAGYGTRFLPATKSMPKEMMPVVNKPLIEYGVEEAIEAGMNGMCIVTGRGKHSLMDHFDKNYELEHQISGTSKEALLDDIRSLIDSASYTYIRQREMKGLGHAILTGRELVGDEPFAVVLADDLCVNEEQGVLAQMVELYKQFRCSIVAVQEVPETETHKYGVIAGEMIKDDIFRIDNMVEKPEPGTAPSNLAIIGRYILTPDIFELIENTEPGKGGEIQITDALMQQAQSGCVIAYKFKGQRFDCGSVEGYIEATNYCYENLYKKASSAELAKTPTVKVSEPA

SEQ ID NO: 15499 - protein, 802 aa, Phanerochaete chrysosporium
QSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWEKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGELAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETTNSGTTYFGQNLVNAVNSGQVSQARIKDMATRILAAWYLLGQDQNFPAVNFNSWNSGQGQHVNVSGNHASLIRTIGAASQILLKNVNGALPLKKPKTIGIIGNGAGSNPSGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPTSAKSAPQNLKGFDSGFLPAGASTTVSFELSRYSFSVWDVVSQSWQIPAGVTGISVGASSRDLRLKGSITN

SEQ ID NO: 15500 - protein, 375 aa, Glycine max
MGSDKILPSHVVANGHAPLDSGHARLKELGYKQELKRDLSVISNFAFSFSIISVLTGVTTLYNTGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLMSQYTLTGFDASAHMTEETKDADRNGPKGIISAVGISIVVGWGYILGITFAVTDILYLLSEDNDAGGYAIAQVFYQAFKKRYGHGTGGIICLVIVAVAIFFCGMSSVTSNSRYINVLPLSAFI

SEQ ID NO: 15501 - protein, 225 aa, Raoultella terrigena
DIAPVTPGVAVDLSHIPTDVKIKGFSGEDATPALEGADVVLISAGVARKPGMDRSDLFNVNAGIVKNLVQQIAKTSPQACIGIITNPVNTTVAIAAEVLKKAGVYDKNKLFGVTTLDIIRSNTFVAELKGKSSSDVEVPVIGGHSGVTILPLLSQIAGVSFSEQEVADLTKRIQNAGTEVVEAKAGGGSATLSMGQAAARFGLSLVRAMQGEKGVVECAYVEGDG

SEQ ID NO: 15502 - protein, 286 aa, Pisum sativum
TGESYAGHYIPALASRIHQGNQANEGIHINLKGLAIGNGLTNPAIQYKAYPDYALDMGIITQTTHDLLGKVLVPACELAIKLCGTNGKVSCLTANVACNLIFSDIMLHAGGVNYYDIRKKCEGSLCYDFSNMEKFLNQESVRDSLGVGKIRFVSCSTEVYMAMLVDWMRNLEVGIPLLLEDGINLLIYAGEYDLICNWLGNSRWVHAMKWSGQKEFVASSDVPFVVNASQAGLLKSYGPLSFLKVHDAGHMVPMDQPKAALEMVKQWTRGTLAESIDGDEKLVADM

SEQ ID NO: 15503 - protein, 307 aa, Saccharomyces cerevisiae
MSSDAKQQETNFAINFLMGGVSAAIAKTAASPIERVKILIQNQDEMIKQGTLDKKYSGIVDCFKRTAKQEGLISFWRGNTANVIRYFPTQALNFAFKDKIKLMFGFKKEEGYGKWFAGNLASGGAAGALSLLFVYSLDFARTRLAADAKSSKKGGARQFNGLTDVYKKTLKSDGIAGLYRGFMPSVVGIVVYRGLYFGMFDSLKPLVLTGSLDGSFLASFLLGWVVTTGASTCSYPLDTVRRRMMMTSGQAVKYNGAIDCLKKIVASEGVGSLFKGCGANILRSVAGAGVISMYDQLQMILFGKKFK

SEQ ID NO: 15504 - protein, 117 aa, Zea mays; identical to SEQ ID NO: 7405

SEQ ID NO: 15505 - protein, 295 aa, Oryza sativa
  unsure (1)..(295): unsure at all Xaa locations
MDLRVAAPASVAAAARCGTSLARPWPARASEDAALEARDSKTVVAVILGGPAAAWLPPPTKRTTKPGPRTAAPPRRLGAPKSRXPRVGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISIYCLPIDDSRASDFGLMKIDDTGRVIAFSEKLKGDDLKAMQVDTTVLGLPQDEAKEKPYIASMGVYIFKKEILLNLLRWRFPTANDFGSEIIPASAKEINV

SEQ ID NO: 15506 - protein, 124 aa, Glycine max
  unsure (1)..(124): unsure at all Xaa locations
AETKRTDXTXNEKAXXQQARARXKXXPTXNHDTRDTDTXEAAXEEPERAQAHQIFFFYSTKDSASQSDVSKLLADQSFVSSILASLPGVDPNDPSVKDLLASLQNQAEPQQKNEDKPPNEEEKK

SEQ ID NO: 15507 - protein, 225 aa, Zea mays
MLFLRCQPRVPSASASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRAVFVLVEADA

SEQ ID NO: 15508 - protein, 530 aa, GIBBERELLA ZEAE PH-1
MAYYSEKDKSPGGGDVENTPDSDGLSRRGPTQSDLLSRSLSARQVQMIAIGGTIGTGLFLGTGKSLATGGPASILIAYAIVGGIVFTTMLALGEMAAFIPVAGSFCTFAGRFVDDAFGFALTWNYWFNDAVSTASDLVALQLILQYWTDNFPGWALSLIFWVVLIALNIISVKAYGEVEYWLSLLKVITIVVFIVMGIVVNCGGNETGEYIGGKYWHLPDAPFVGGIGGFASVFVTASFAYGGTESIAITAGETKDPTKNIPKVVKNVFWRILLFYILSILIIGLNVPYNYPDLNSKETRTSPFTIVFEMTGAKAAGSVINAVILTSVLSAGNHALFAGVRLMYTLALEGHAPKVLGKLNRNRVPWVAVLVTGFVAGLCFGSSFIGAGQLWSWLQNIVGVSNQLSWISIGITSIRFRQALELQGKTHLLPFKNWTYPYGPWICVFLNSFLVLVQGWSCFSPKFDVVSFISFYIELPVMLIMYIGWKLLKKTKVVKLSEMDLETDVHTIEEKVTEEAGWKNKLKNAVTWLF

SEQ ID NO: 15509 - protein, 243 aa, Zea mays subsp. mexicana
SIRNNPVQNKVMNGEDPINNNHAQTAGGLGVRLATSSSSRDPSPSDEDMDGEVEILGFKMPTEERVRKRKESNRESARRSRYRKAAHLKELEDQVAQLKAENSCLLRRIASLNQKYNDANVDNRVLRADMETLRAKVKMGEDSLKRVIEMSSSVPSSMPISAPTPSSDAPVPVPPPIRDSIVGYFSAPAADDDASVGNGFLRLQAQEPASMVVGATLSATEMNRVAAATHCAGAMEPIQTAMG

SEQ ID NO: 15510 - protein, 159 aa, Zea mays
  unsure (1)..(159): unsure at all Xaa locations
MRCSSLPVLLDFYHLIPHLAHXATTSSPHPPPDAGASPGTAFLKCIHQRDDLLRAPTFLQXPGRMKAAIVHISTVILDGEAPETSPDPRVVYESLYAARAHLWTXVDNNVPVLFIGDXIRFXPHLIHAFKPNPWSHVNEYWRVFDFLSHLPERLHTFFF

SEQ ID NO: 15511 - protein, 444 aa, Bacillus cereus
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEFEWDIFRTQVHQWERDQYMSLY

SEQ ID NO: 15512 - protein, 989 aa, Nostoc punctiforme
MVLQVQTSSYEAKTQEIAKQLLAATQENRSFFSSLRDQMRWDDKLLAWAMSNPGLRVQLFRFIDTLPALHSKSEIASHLQEYLGDESVELPAALKGMLNFANPDSMPGQVAATTVGTAVETLAHKYISGENIKQVIKTVERLRKEKMAFTIDLLGEAVITEAEAQSYLERYLELMQQLVEASKNWAAIPAIDEADGEPIPKVQVSVKLTAFYSQFDPLDAKGSEERVSDRIRILLRRAKELGAAVHFDMEQYAYKDITLSILKKLLLEEEFRQRTDIGMTIQAYLRDSEQDAKNVISWLKERGYPLTIRLVKGAYWDQETIKASQKHWKQPVYNDKAATDANFETITQLLLENHQYVYSAIGSHNVRSHSRAIAIAESLNVPRRRFELQVLYGMGDKVAKALVDRGYRVRVYCPYGELLPGMAYLIRRLLENTANSSFLRQNLENRPIEELLAPPIVKEGKSLTPNSHFLGAADTDYAVEEIRTKAAQAFQSVRQQLGKTYLPLINGEYVNTPEFVDSLNPSNFSEVVGKVGLISVEQAEQAMQAAKAAFPGWRKTPAKQRADILRKAGDLMELRRAELSAWIVLEVGKPVKEADGEVSEAIDFCRYYADEIERLDKGVNYDLAGETNRYIYHPRGIVVVISPWNFPLAIACGMTVAALVSGNCTLLKPAETSSVIAAKLTEILIDAGFPKGVFQYVPGKGSQVGAYLVNHPDTHVIAFTGSQEVGCRIYAEAAILKPGQKHMKRVIAEMGGKNAIIVDESADLDQAVVGVVQSAFGYSGQKCSAASRVIVLEPIYEAFVQRLVEATKSLNIGEAELPSTQVGPVIDANARDRIQKYIEIGRQSAEVALELPAPKQGYFIGPVIFSEVSPNAVISQEEIFGPVLAVIRVKDFQEALAVANGTNYALTGGLYSRTPSHIQQAQTEFEVGNLYINRNITGAIVGRQPFGGFKLSGVGSKAGGPDYLLQFLEPRAVTENIQRQGFAPIEGAD

SEQ ID NO: 15513 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRYGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 15514 - protein, 498 aa, Aspergillus kawachii
MVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 15515 - protein, 248 aa, Oryza sativa; identical to SEQ ID NO: 6785

SEQ ID NO: 15516 - protein, 512 aa, Escherichia coli K12
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 15517 - protein, 529 aa, Oryza sativa (japonica cultivar-group)
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGGLIGAEFGFSGVADIPKAYAAFVVLFICAYVAGFAWSWGPLGWLVPSEIFPLEIRSAGQSINVSVNMLFTFIIAQAFLPMLCRFKFILFFFGAWVVIMTLFVAFFLPETKNVPIEEMVLVWKSHWYWGRFIRDEDVHVGADVEMPAAGNRNGKVDPAKLAN

SEQ ID NO: 15518 - protein, 463 aa, Streptococcus pyogenes MGAS315
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 15519 - protein, 155 aa, Triticum aestivum
  unsure (1)..(155): unsure at all Xaa locations
MAPTVMASSATSVAPFQGLKSTAGLPVSRRSNGASLGSVSNGGRIRCMQCWPIRGHQEFRDPVLLPPLNTXASLXVDYLIPLQVGPCLQFNKXFIFPFSTTTPGYYDGXYWAXWXLPIFXCTDXTQVINEVXGVQEGYLTLCRINRHNSACVNTP

SEQ ID NO: 15520 - protein, 271 aa, Beta vulgaris
GKSTFMRRLTSVFGGAAEPPKGGNPDSNTLISDTTTVICLDDFHSLDRTGRKEKGVTALDPRANDFDLMYDQVKALKQGKPVDKPIYNHVSGLLDPPEVIQPPKILVIEGLHPMYDARVRELLDFSLYLDISNEVKFAWKIQRDMKERGHSLESIKASIEARKPDFDAYIDPQKQYADVVIEVLPTQLIPDDDEGKVLRVRMIQKEGVKFFNPVYLFDEGSTISWIPCGRKLTCSYPGIKFSYGPDTYYGNEVTVLEMDGIFDRLDGLIYV

SEQ ID NO: 15521 - protein, 299 aa, Cucumis melo
MALEAVVFSQDPLCYNGSKDLYSLLGGGIWANGSFEYPEIPHDFPENQTENFPFEDWNSSSSVFVPNPSPEAADSRNGLLKPPLEAESITPHPIRPRKRRPKSRKNKEEIENQRMTHIAVERNRRKQMNEYLSVLRSLMPESYVQRGDQASIIGGAINFVKELEQQVQVLSTIETKGKINNSAEGCCNSNSNSNSKIPFAEFFSFPQFKAMEGCSLVSENETQCSSTVADIEVTMVENHANLKIRSKRRPKQILKIVAGLHSLSLSVLHLNISTINQIVLYCLSVKVCFSSFFEMGICV

SEQ ID NO: 15522 - protein, 322 aa, Xanthomonas axonopodis pv. citri str. 306
MTASPSKLAQLRELSVVVADTGDYDAIKRLKPVDCTTNPTLVKKALDLPVYADLIERELAWGREHGGDDRTATVNEVADRLTIGVGVKLAELVPGRVSTEVDADLAHDTQATIAKARKFIAMYAERGVSKDKILIKIAATWEGIEAARQLQKEGIDCNLTLIFNRSQALACAEAGVFLISPFVGRILDYYVAQGQTPASIDEDPGVVFVRTVYNEFKQRGSSTVVMGASFRSTAQIEALAGCDRLTISPDLLEKLDAEHGELPRKLSPAQADNAQFTPIDSDSFASGLAADPMATEKLAGGIDTFAKDLHALRKTIADKLAG

SEQ ID NO: 15523 - protein, 346 aa, Glycine max
MAHPTSSSGQSNDLTKEDCKETSSVVVCFGEMLIDFVPMVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAAVI

SEQ ID NO: 15524 - protein, 486 aa, Medicago sativa
MAPPLTRIGLAGLAVMGQNLALNIADKGFPISVYNRTTSKVDETVERAKQEGNLPLYGFHDPEAFVNSIEKPRVIIMLVKAGAPVEQTTKTLSAYLEKGDCIIDGDNEWYENTERREKEVAELGILYLGMGVSGGEEGARRGPSMMPGGSFEAYKYIEDILLKVAAQVPDSGPCVTYIGNGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLMDERVEAAKVFKSGGFGDILTDQQVDKKQLIDDVRKALYAAKICSYAQGMNLIRAKSAEKGWDLALGELARIWKGGCIIRAIFLDRIKQAYDRNPNLANLLVDPEFAKEIIERQTAWRRVVSLSVNSGISLPGMSASLAYFDSYRRERLPANLVQAQRDYFGAHTYERVDIEGSYHTEWFKLAKQSRI

SEQ ID NO: 15525 - protein, 478 aa, Gelidiella pannosa
IKNQRYESGVIPYAKMGYWDPDYKVKDTDILALFRVSPQPGVDPVEASAAVAGESSTATWTVVWTDLLTACDLYRAKAYKVVEVPNTTDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAAAGEIKGHYMNVTAATMEDMYERAEFAKQLGTIIIMIDLVIGYTAIQTMAIWARKNDMILHLHRAGNSTYSRQKIHGMNFRVICKWMRMAGVDHIHAGTVVGKLEGDPAMIKGFYNTLLLPYLEVNLPQGIFFEQDWASLRKVTPVASGGIHCGQMHQLLDYLGNDVVLQFGGGTIGHPDGIQAGATANRVALEAMVLARNEGRDYVAEGPQILRDAAKTCGPLQTALDLWKDISFNYTSTDTADYSETPTANV

SEQ ID NO: 15526 - protein, 372 aa, Streptococcus ratti
MNIQPFGVEEWLNVWENDAIYDIAGSSISSMTLKEILSIGDKPQEVLIDELLKKKMNYGWIEGSPDFKEEVAKLYDHAKPNQILQTNGATGANFLALYALIERGDHIISLYPTYQQLYDIPRSFGAEVDFWEIKEENNWLPSLDDLQHLIKPNTKMICINNANNPTGAVMDRSFLEKLVELARAADIYILSDEVYRPLEEELDVPAIYDLYDKGISTHSLSKTYSVPGVRVGWIVANDELSDLFRKYRDYTMICAGVFDDYIATHILKNKDRVIERNKKIVSENLQIVKDWVAKEPRVSLVVPKKVSTSFIKLDIPEETEPFCIRLLKEKGVLLVPGNRFDLPGYARLGYCTDKATLIKGLSELSEFLRQFD

SEQ ID NO: 15527 - protein, 438 aa, Pinus radiata
MVLENFGGVGAREASCRIRHELRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYGDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 15528 - protein, 394 aa, Zea mays; identical to SEQ ID NO: 926

SEQ ID NO: 15529 - protein, 453 aa, GIBBERELLA ZEAE PH-1
MADFKAYLDELEQDFVIDTAKLKHVTNHFVQELEKGLSIKGGSIPMNPTWVTNYPDGNEKGKSLVLDMGGTNLRVYSIQLTSEKGGFEVKQESHKLPEELKTATADELWDFIAGCLDSFLQSADFDLSTEIDLSFIFSFPTTQRTIDEGILQRWTKGFNISNTEGKDAAESLRQAIKKKNLPLKVRVVTNDTTATMMASAYLNSDTEIGCVFGTGCNGAYFEKVGAIPKLANDNLNGESFMAINCEWGAFDNEHAVLPLTSYDIAIDEDSPRKGQQAFEKMVAGLYLGELFRRIILEIHQRDPHTFLEGQSMERLNDTYCLDSSFLSAIEEDASDGLREAYETCVSSLGISPTLAELQFMKAVATLITTRAARLSATGVAAICQKRDLQQCHVGVEGSLFEKHPHFQLELSKAVGEILAPVAEPDTRKSNVEFMLSPGSGVGAAVIASTLKER

SEQ ID NO: 15530 - protein, 532 aa, Neurospora crassa
MGLFSKKSAAPQTQSQDEIDLAAEQKVTFRAVFLGVVASVGGFMFGYVSGQISGFFDMEDFGRRFGNYQDADGWVFSAYRQGAIVALLPAGALLGSLVAGRIADTLGRRIAISASALFSCIGTIIEIASTTHWAQFAVGRLITGIGIGALSVVVPMYQSESAPAILRGILVSCYQLFITLGIWTAEMINYGTHDLSNSASWRIPNGISFLWALVLGGGILFLPESPRYAYRVGREDEARNTIARLAGLEPSARSVNMQIDEIRMKLEEEKAGADTKWYEIFGPALLRRTLIGIILQSGQQLTGANFFFYYGTTIFKATGLSDSYVTQIILGSVNAGCTVAGLWVVKNVGRRKALIGGALWMTMCFLVYSFVGRFVLDPVNPASTPQAGNVLIVFSCFFIVAFATTWGPLVWAVVAELYPARYRAPAMALATASNWLWNFLMSLFTRPITDSIGYFYGLVFAGCCLALAAFVWLFVIESKDRTLEEIETMYNQKVSPRHSTHWHAEVPSGPRDAEEKPEVHSGSATTSSHGEV

SEQ ID NO: 15531 - protein, 735 aa, Neurospora crassa
MHLRIFAVLAATSLAWAETSEKQARQAGSGFAAWDAAYSQASTALSKLSQQDKVNIVTGVGWNKGPCVGNTPAIASIGYPQLCLQDGPLGIRFGGSVTAFTPGIQAASTWDVELIRQRGVYLGAEARGVGVHVLLGPVAGALGKIPNGGRNWEGFGPDPYLTGIAMSETIEGIQSNGVQACAKHFILNEQETNRDTISSVVDDRTMHELYLFPFADAVHSNVASVMCSYNKVNGTWACENDKIQNGLLKKELGFKGYVMSDWNAQHTTNGAANSGMDMTMPGSDFNGKTILWGPQLNTAVNNGQVSKARLDDMAKRILASWYLLEQNSGYPATNLKANVQGNHKENVRAVARDGIVLLKNDDNILPLKKPSKLAIIGSSSVVNPAGRNACTDRGCNTGALGMGWGSGTADYPYFVAPYDALKTRAQSDGTTVNLLSSDSTSGVANAASGADAALVFITADSGEGYITVEGVTGDRPNLDPWHNGNQLVQAVAQANKNTIVVVHSTGPIILETILAQPGVKAVVWAGLPSQENGNALVDVLYGLVSPSGKLPYTIAKSESDYGTAVQRGGTDLFTEGLFIDYRHFDKNGIAPRYEFGFGLSYTNFTYSSLSITSTASSGPASGDTIPGGRADLWETVATVTAVVKNTGGVQGAEAPQLYITLPSSAPSSPPKQLRGFAKLKLAPGESKTATFILRRRDLSYWDTGSQNWVVPSGSFGVVVGASSRDLRLNGKFDVY

SEQ ID NO: 15532 - protein, 474 aa, Stichogloea globosa
RYESGVIPYAKMGYWDADYNVKTTDVLALFRITPQPGVDPVEAAAAVAGESSTATWTVVWTDLLTACDIYRAKAYRVDPVPGTTDQFFAYIAYECDLFEEGSLANLTASIIGNVFGFKAVKALRLEDMRIPYAYLKTFQGPATGLIVERERLNMFGRPMLGATVKPKLGLSGKNYGRVVYEGLRGGLDFLKDDENINSQPFMRWRERFLYVMEGVNRASAATGETKGSYLNVTAPTMEVMYERADYAKSIGTIIVMIDLVIGYTAIQSMAIWARKADMILHLHRAGNSTYARQKNHGINFRVICKWMRMAGVDHIHAGTVVGKLEGDPLMVKGFYNTLLQTSLEVNLAQGIFFDMDWASLRKTVPVASGGIHCGQMHQLVYYLGDDVVLQFGGGTIGHPDGIQAGATANRVALESMILARNEGRDYLNEGPQILRDAAKMCGPLKTALDLWKDISFNYTSTDTPDFVETATESK

SEQ ID NO: 15533 - protein, 234 aa, Hordeum vulgare subsp. vulgare
MGRGRIEIKRIENTTNRQVTFCKRRNGLLKKAYELSVLCDAEVALVVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVAPYDSRNFLQVNMQQQQHYSQQLQPTALQLGQQYFN

SEQ ID NO: 15534 - protein, 471 aa, Neurospora crassa
MGGGQDPSKSKKDKVGWLQLRQGFCCARHACCPKDKPKYEPPPKPTTRIGRKKKRQGGASAAAKLPSVYPTSRCKLRLLRMQRIHDHLLLEEEYVENQERLRKAKTAKDSNAPASELESSDRMADERSRVDDMRGSPMGVGVLEELIDDDHAIVSSTSGPEYYVSIMSFVDKDLLEPGASVLLHHKSVSIVGVLTDDTDPAVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAAENAPSIVFIDEIDAIGTKRYDSTSGGEREIQRTMLELLNQLDGFDDRGDVKVIMATNKIESLDPALIRPGRIDRKILFENPDQNTKRKIFTLHTSKMSLNEDVDLEEFIAQKDDLSGADIKAICSEAGLMALRERRMRVQMADFRAARERVLRTKQEGEPEGLYL

SEQ ID NO: 15535 - protein, 318 aa, Dendrobium crumenatum
MELLEGSRRSDAMAVLRDACENWGFFELLNHGISHEPNEQSETVNKEHYREHYRRFREQRFKEFAAKTLDSGENVDGDNLDWESTFFLRHLPTSNISQVPDLDEDCGSTMKEFALGLEKLAERLLDLLCENLGLEKGYLKRVFCGGSDGLPTFGTKVSNYPPCPKPELIKGLRAHTDAGGIILLFQDDTVSGLQLLKDEEWIDVPPMRHSIVVNIGDQLEVITNGKYKSVMHRVVAQTNGNRMSIASFYNPGSDAVIFPAPELVEKEAAEKKKETYPKFVFEDYMKLYVRQKFEAKEPRFEAMKTMDAVISSQPIPTA

SEQ ID NO: 15536 - protein, 483 aa, Xylella fastidiosa Temecula1
MLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPVYWVIAPTGAAACLYLFWQPFTEHWPLMVGWTVLGLVMYGLYGYQHSKLRHGG

SEQ ID NO: 15537 - protein, 359 aa, Zea mays; identical to SEQ ID NO: 14525

SEQ ID NO: 15538 - protein, 773 aa, Nostoc sp. PCC 7120
MQEDFRLIVDLVSVLAVAACGGLFAALLKQPVLLGYLIGGMVVGPAGLGLIKEVIQVETLAQFGVAFLLFALGVEFSFAELKKVKAIALGGGGLQIALTILTTVLVCGLTGAWGALPAKGVFLGSILSLSSTAVVLKCLMERNETETPHGQVMLGILVVQDLALGLMLAVLPALHEPGEVIVVAVLTALVRIGLFAAGAVAAGIWVIPPLLRLLARTESRELFLLGVVALCLGIALLTESLGLSIEMGAFVAGLMISEVEYADQTLTYVEPLRDIFASLFFAAIGMLIDPVFLLQNIELILGLVALVFLGKFLIITPLVKLFRYPLKTALIAGLGLAQIGEFSFVLASEGQALGLVSRRVYLLILGTTAVTLMLTPFVLRVLPAVFNFAESIPWLKPYIAGEGQALDISEDLPFQDHVVVCGYGRVGKNLVKLLQQHNMPVVVIDQSESRIQQLRDAEIPYVYGNCVSLHVLETAGVSHAKGMAIALPDPMSTRLCVKRALELCPELDLVVRATQDKNIELLYQLGAREVVQPEFEASIEMATHLLTDVGWTSGLLQQEMQQIRSDHYLDFRPERNADEVSRHLQQATQDLNRRWYALPADSPLIGMNLEEADMRYLTGVSLMAIRRANGEEIDYPSNQTKLAAGDRLLIVGAKEELAALEEFAQGKVGVPGQNSACQWVAVDANSAVLGKTLKDLALDIQSGIKVQAIRRDGKFIRSPNDNIDLRTGDQVLLCGSLPSLNQIQPLFAVVNEIPLAIPIVKAKETEVVKEMRG

SEQ ID NO: 15539 - protein, 224 aa, Triticum aestivum
  unsure (1)..(224): unsure at all Xaa locations
MAGGGGRGRGEEEYDYLFKVVLIGDSGVGKSNLLSRFTRNEFCLESKSTIGVEFATRTLHVEGKIIKAQIWDTAGQERYRAITSAYYRGALGAVLVYDVTKPTTFENIARWLKELRDHADANIRIMLVGNKTDLKDLRAVPTDDAGGYAEAEGLSYIETSALEAMNVEXRAFQLILGDIYRTVSKKAVASEEDRAGAAGVKEGKTINVAATADNGGEKKQCCSA

SEQ ID NO: 15540 - protein, 729 aa, Brucella melitensis 16M
MPEYKDLVPHSFWREIVPTTEDRAAFDLALGGTMLSQMHLIRAFEEKVLELAGQGLVHGPAHSAIGQEGGAVGSAVSMRPSDQINGSHRAHHQFLAKALGYVAQKGIDPKAAFDQDIRTLAQRTLAEILGLSQGFCRGRGGSMHLRWAESGNLGTNAIVGGGVPMAAGAAWAHRRAGKGDVVYTYFGDGATNIGSVLETMNLAAAWKLPICFFIENNRYAVSTHVEEVTAEPRLSSRGLAFGIPSFKVDGMDPIAVWLASEEANAIMRAGNGPTIIEADVYRYFHQNGPLPGSAFGYRSKDEEAEWRGRDPLDALAKTLLERQALGEDAIKALRERCVSLMDEVAGQLIEMRDGKRRIIPSLWPEESFRDFGLRGDLSEFDGVRFEEQESFSGKLVEDARFIDTVADVMARRMETDERVVVLGEDVHRLKGGTNGATRGLSADYPDRVLGTPISENAFTGIAGGMAADGRVLPVIEFMYPDFMWVAADQVFNQIGKARHMFGGDSDMPVVLRTKVAMGTGYGSQHSMDPAGIFATAPGWRIVAPSTPFDYVGLMNSALLCRDPVLVLEHVDLYASKGAAPAEDFDYFIPLGKAKVVRPGSRVTVLTYLAMVAKTQAVVEALGVDAEIIDLRSLDRAGVDWETIEASVRKTGNVLIVEQGASGTSYGGWLADELQRRCFDWLDQPIARVHGAEASPSISKVLEAAAAARPQDIEAGLRAVMAAQGLPIEN

SEQ ID NO: 15541 - protein, 333 aa, Zea mays
HRLGVWTVNVNPTHASSPPVQVPHRPLVAFPSRRAMDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQDEVVTRIEERISAWTFLPPENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPVIEGQKWSATKWIHVRSFDLTVKQPGPSDGCEDDNVLCPQWAAVGECAKNPNYMVGTKEAPGFCRKSCKVCAE

SEQ ID NO: 15542 - protein, 334 aa, Nostoc sp. PCC 7120
MTTKPERVVLIGVAGDSGCGKSTFLRRLIDLFGEEFMTVICLDDYHSLDRKQRKETGITALDPRANNFDLMYEQIKALKEGQTINKPIYNHETGLIDPPEIVKPNHIVVVEGLHPLYDERVRSLLDFSVYFDISDEVKIAWKIQRDMAERGHRYEDVLAAINSRKPDFQKYIEPQREFADVVLQVLPTNLIKDDTERKVLRVRMLQREGKEGFEPAYLFDEGSTINWTPCGRKLTCSYPGMQLYYGSDVYYGRYVSVLEVDGQFDNLEEVIYIETHLSNTSTKYQGELTQLLLQHREYPGSNNGTGFFQVLTGLKMRAAYERLTTKEAKLAVQV

SEQ ID NO: 15543 - protein, 145 aa, Glycine max
  unsure (1)..(145): unsure at all Xaa locations
SSLGHRVIKQEVPIYAVGLSVFXTICMALTSLASIVAFEAMVSIAVIVLYIAYALPIIFRVTLAQKHFVPGPFNLGRYGIIIGWVSVLWVVFISKLFSLPVSYPITIQTLNYTPVALGCLIILVVSYWILSARHWFKGPITNVKH

SEQ ID NO: 15544 - protein, 216 aa, Sanguinaria canadensis
IENTTNRQVTFCKRRNGLLKKAYELSVLCDAEVALIVFSNRGRLYEYANNSVKSTIERYKKTCQDPSNSGCAVEANTQFYQQEASKLRQQIGFLQNSNRNLTGEALSSMTVKELKQLETRLEKGISRIRSKKNELLFSEIEYMQKREIDLQNDNMYLRAKIAENERAQQHMNLMPGNEYDVMTSSAYDSRNFLQVNLLESTNHHYSRQEQTALQLG

SEQ ID NO: 15545 - protein, 762 aa, Zea mays
  unsure (1)..(762): unsure at all Xaa locations
MWRLKIGEGGGPWMQTASGFHGRQVWEYDPDAGTDEERSKVEQLRRAFTENRFRSXESQDLLMRMQLTGQKHLHADLPAATKIEEDGDEVPLTEERLRESLRRALGCMAALQAEDGHWPPGDYSGVMYLMPFWIFALHITGTVDAVLSKEHRREICRHIYNHQNEDGGWGFNVIDESAMFSTCLNYTSLRLLDEVQREENDGLAKGRAWILSHGTATAAPHWAKILLSVIGVYDWRGNNPVVPELWLVPRFLPIHPGRFWCFTRIMYMSIAFLYGKKFVGPITPTILALREELYSLPYVHIDWSKARNSCAKVCHRSSLTLNYYFIAXTCLNMFVEPVLNYWPLNKLRERALNHILEHIHYEDETTQYIGISPVTKALNMICCWVENPNSDALKRHIPRIHDYLWIAEDGMNTKIYDGTHNWELALIIQAMLSADAANEYGPTIQRAMEYLKRAQVTTNPPGNPSYWFRHRSKGSWPLSTIDNGWGSSDTSAEATKALLMISKVYPNLVENSNGDEWMLNAVDCLLSFMNKDGSVSTFECQRTYSWLEILNPLESFRNIVADYPTVECTSSVLQALVLFEEFNSEYRSKEIKENVKKAAIYIENNQNKDGSWYGTWGICFVYGTLYAIKGLVAAGRNYENSICIRKACNFLLSIQLKTGGWAESYHSCERQVYVEGHSTHVVQTAWAMLALIYTGQMERDPTPLHRAAKVLINMQLETGDYAQQEHVGSTNCSVYFNYPNYRILFPVWALGEYHRKVCTKSN

SEQ ID NO: 15546 - protein, 120 aa, Glycine max
MAGMVFGLDAPMMAALQHLLDIPDGEAGAAAGEKQGPTRAYVRDARAMAATPADVKELPGAYAFVVDMPGLGSGDIKVQVEDERVLVISGERRREEKEDAKYLRMERRMGKLMRKFVLPE

SEQ ID NO: 15547 - protein, 177 aa, Streptococcus oralis
TSIMFDGSHLPVEENLKLAKDVVEKAHAKGISVEAEVGTIGGEEDGIIGKGELAPIEDAKAMVATGIDFLAAGIGNIHGPYPANWEGLDLDHLKKLTEALPGFPIVLHGGSGIPDEQIQAAIKLGVAKVNVNTECQIAFANATRKFARDYEANEAEYDKKKLFDPRKFLADGVKAIQ

SEQ ID NO: 15548 - protein, 473 aa, Sulfolobus acidocaldarius
MPGLPKNEHEALEFLKSNNIKWVDLQFTDLLGKLQHITIPSNEFDESSFKVGFGKLDGSSIKGFTSIYESDMVLLPIPQTMTLIPWMQGVARVLTKVFWGGGKGRFERDPRGIAEEAEKYQSEQGYVSYFGPELEFFVFDKVEVDASLPQSGTGYKIHSREAPWSKNGGYVIRYKEGYYPASPVVQLMDIRLEIISTLVDYFGTIEAAHHEVATAGQGDIDFRFSTLADTADKVQVLKYVTKNIASKRGMIATFMPKPFFGDNGSGMHTHFSLWTKDGKNLMYDPNDEYAELSQIGRYIIGPLLEHGRALSAIVVAGTTNSYRRLVPGYEAPVYLVWSKSNRSAAIRIPAYYKGMEKAKRLEYRPPDPSSNPYLVFSAILMAGLDGIRRKLDPGDPVDENIYHMSEEKKRSLKIRELPGSLDEALNELESDNEFLKPVFNSSILQAYLDLKKEEAKMMQLYPHPMEIYQYLDS

SEQ ID NO: 15549 - protein, 298 aa, Bacillus cereus ATCC 14579
MKLGLIGLGKMGFPLAEHLYEDKHEVVVYDVNKELVEKAGKLGITARHTLKEMIAELEAPRTIWVMVPAGEVVESVLKDVYPLLDEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 15550 - protein, 219 aa, Zea mays
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNTRIMLVGNKTDLRHLRAVATDDARSFAEAEGLSYIETSALEATNVEEAFQLILGDIYRAVSKKPVASDEVGAGQGGVKEGKTIDVATGADAAAHKKQCCSA

SEQ ID NO: 15551 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 15552 - protein, 527 aa, Perilla frutescens
MDACCATLKSTSHLSNVSKSAFCGEKNGFWGEKIKGSLNNCARAYQFGKKLNLEKRGRKIKPGVAYSVLTKKNINETLMIPPPLFEKRGANPKIVAAIILGGGAGKQLFPLTSKAATPAVPVGGCYRLIDIPMSNCINSGINKIFVLTQFNSASLNRHISRTYTGNGVSFGDGFVEVLAATHTAGETGNQWFQGTADAVRQFTWVFEDAKAKDIDNILILSGDHLYRMDYMDFVQNHIDRNADITLSCAPVCDSRASEYGLVKIDSRGRIILFSEKPKEADRMAMEVDTSIIGLSPEEALKSPYIASMGVYAFKTDVLLKLLRWRYPTSNDFGSEIIPSSVKEHNVQAYIFRDYWEDIGTIKSFYDANLALTDEFPKFEFYDPKTPFYTSLRFLPPTKIDNCKIKDAIISHGCFLRECVCQHSILGERSRLDSGVELKDTLMMGADYYPTESEIASLLVQGKVPMGIGRNTKISNCIIDKNARIGKDVIIKNKDGVEEADRSEEGFYIRSGITIVVEKATINDGTII

SEQ ID NO: 15553 - protein, 479 aa, ASPERGILLUS NIDULANS FGSC A4
MSSQIDTTHYPGNIINNQFVPSARTRHSTNPSTGEPLYEVPWATEEDVDRAVEHARTAFKSWSRLPFQERSRLLVAYADAVEAERAPLAKLLVLEQGKPLSLAQTELDMSVQWLRTFVTMEVKDELLDDNEERSITQTFPPLGVCCGIVPWNWPVLLALGKVGPALITGNTMIIKPSPYTPYCDLKLGEIGMRIFPPGVLQVLSGGDELGPILTQHPGIDKITFTGSSATGKLVMQSCAKTLKRVTLELGGNDPAIICEDVDIDAIVPKITSLAFLNSGQICMLIKRVYIHESIYDAFRDAMVAFAKSIKTADGFEPDAFVGPIQNSMQYEKVKDMYSEIGKRNWKQALEGKVFENSKGYYISPAIIDNPPEDSRIVLEEPFGPIVPLLKWSDEEDVIARANSLKDGLGASVWSKDLDRAERIGRQLSAGSVWLNSHFDVAPNVPFGGHKWSGLGSEWGMTGLKQYCNSTSLWKWKKVM

SEQ ID NO: 15554 - protein, 696 aa, ASPERGILLUS NIDULANS FGSC A4
MTLNLDSKDHSNFRLPHFPPPLHTRSGNEAFDRPSTPRDDGFTSPISTPLGSPSKSRMPPGALDLPSVFDNALKLQPSSPTKNAHNNFNHPMFTLPNQSGETFNESVIRPASPSRRPKNENTLPQSAPLTKDLGRNPAAAAISRQEQYHTRDLESVQRRQVPMRGLTPEELEKLQNPRVKRLVNVTQLYFLDYYFDLLSYVHNRQTRYSQFCAANPEPPATPIEEYEPALSKYLGRERAHLRKRRTRLRQGDFQILTQVGQGGYGQVYLASKKDTKEVCALKVMSKKLLFKLDEIRHILTERDILTAAKSEWLVKLLYAFQDETQIYFAMEFVPGGDFRTLLNNTGVLHNRHARFYIAEMFCCIDALHALGYIHRDLKPENFLIDSTGHVKLTDFGLAAGMLNPRKIESMRVKLEEVGNTPVPFGRPMEQRTMAERRQGYRSLRERQVDYAKSIVGSPDYMAPEVLKGEEYDFTVDYWSLGCMLFEALAGYPPFAGSTVDETWQNLKNWQKVLRRPVYEDPNYFLSKRTWNFITTLVASREHRFKNISEIHAHEYFSEVDFSRLREQRPPFVPQLDSETDAGYFDDFENEADMAKYKEVHDKQRALEEMAERDEKMAKGLFVGFTFRFVPCFLLVNDESNQLQTSQAEHRRNWASLSPQADTNRGLWYYLLGLMTLLSPLSLLWSGQAGLEWPLSD

SEQ ID NO: 15555 - protein, 109 aa, Zea mays
  unsure (1)..(109): unsure at all Xaa locations
KITAFPCLTYIAVNKEGETVSNISPNAANADTWGVCPGKDIIHATDADHASLMVGKDEAYEIWTRGWGRMYPEGDASRDLLXKVQMTYYLVTLVDNYYIQGDLLASLTI

SEQ ID NO: 15556 - protein, 178 aa, Rhodobacter sphaeroides
KPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGITGDEANALASMGIYVFK

SEQ ID NO: 15557 - protein, 313 aa, Pyrococcus furiosus DSM 3638
MLTVELVLVGVSFYLLWNIGANSSANALGAAVGSGILNFRQAVFITSLLSFLGAYLRGEAVMKTVGDKLVSGLSTEALIIVLLSSGLVITLATVKGLPLPATQGIVGSLLGVGLAFGASIDWKTFYLIVLAWVASPFISMLFSIFLYRYYSIFVRRIKSIKRLEILYKWMAIVSGSYIAFTLGTNDIANAVAPLVGAETFTPQEASIFGALCLSLGAYTLSYPIMHIIGKKMVELDPLSAFSAQMGAAFSISIANYFGFPVSSGQAVVGGIVGISLSTGERIKKKTVQHIALGWVVAPLFSMSLSYVLVKLLL

SEQ ID NO: 15558 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 15559 - protein, 384 aa, Glycine max
  unsure (1)..(384): unsure at all Xaa locations
MVGETAATGKSVGLGLGCDPVVGSLACSKKREYRVTNRLQEGKRPLYAVIFNFIDSRYFNVFATVGGNRVTVYQCLEGGVIAVLQSYVDEDKDESFYTVSWACNVDGTPFVVAGGINGVMRVIDVGSEKIHKSFVGHGDSVNEIRTQTLKPSLVISASKDESVRLWNVHTGICILIFAGAGGHRNEVLSVDFHPSDIYRIASCGMDNTVKIWSMKEFWTYVEKSFTWTDLPSKFPTKYVQFPVYNASVHLNYVDCNRWLGDFILSKSVDNEIILWEPKVKEQTPGEVXLDILQDYPGPELDQWNLYLGNWGYNTQKEREEAAAIPRIHVLGLSDFSKKRITKALFCLLKEITRQTATSFDGSTILSCCEDGTIWRWDDVTNSPD

SEQ ID NO: 15560 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGI

SEQ ID NO: 15561 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVXRRMIGTDAFQETPIVEVTRSITKHNYLVMDVDDIPRIVQEAFFLATSGRPGPVLVDVPKDIQQQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKILENRAEELKLDFGVWRSELKEQKQKFPLSFKTFGEAIPPQYAIQVLDELTDGKAIISTGVGXHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEXDGRTKY

SEQ ID NO: 15562 - protein, 174 aa, Prochlorococcus marinus str. MIT 9313
MGMSLSQSLDLPDLDRVDTLAQELALLQDKGKRRIAMLGSRHVPVVAIHLVELMARSLAQEGHSLITSGSQGVNAAVIRGVLEADASCLTVLLPQSLDRQAPEIRDQLDSVLHLIEKPEHDELSLPMASSLCNQEIISRCDQLICFAFHDSETLLTSCRTAEDMGKVVSLLFFD

SEQ ID NO: 15563 - protein, 124 aa, Prochlorococcus marinus str. MIT 9313
MMSDALSSIDDQLSQRFIALDPSGYFLIQVDASAAELVVEHYLNDVDELGRATDPVTGEVLACRGGIRSPATVYRGRTAKQLGIQLTEGQGPYPLSKLDHALYLGRELQRAESCLLSGTPYVQD

SEQ ID NO: 15564 - protein, 137 aa, Corynebacterium efficiens YS-314
MTDFKLITDAEWRERLNPEEYRVLRQAGTEAPHVGEYTNTTTEGVYSCRACGEELFRSTEKFDAHCGWPSFFSPLAKDKIIEKEDLSLGMRRIEVLCANCGSHMGHVFEGEGFNTPTDLRYCINSISLRLEEKPVSE

SEQ ID NO: 15565 - protein, 420 aa, Haemophilus somnus 129PT
MEILQEYGTILVIITAVFGFLMAFGVGANDVANAMGTSVGSGTITAKQAIFIAMFFECAGAYLAGGEVTETIKSGVIDPMQFTDTPEILVFGMMAALFSSGIWLLIASKMGWPVSTTHAIIGAIVGFACITVGAHAVDWGTVRNIVGSWFITPILAGIIAYAIFFSTQKLIFDTPKPLANAQKYGPFYMGLTVLILAIVTMTKGLKHIGLHLTTIETLIISGIISIIAGILGSFYFRSQRFIQNVTKGTFGAVEKVFSILMLLTACAMAFAHGSNDVANAVGPLSAVVSIIEHGGEIAGKTTLAWWILPLGSVGIGVGLIVMGYKVMSTIGTGITDLTPSRGFAAQFATAVTVVLASGTGLPISTTQTLVGAILGIGFARGIAAINLTVIRNIVASWIVTLPAGTFFAIVIYYIIYAIFH

SEQ ID NO: 15566 - protein, 445 aa, Desulfovibrio vulgaris subsp. vulgaris (strain Hildenborough)
MQQRFFRVLTVSELVALLRTCAPLGAECPTAGRSDSLPIEDAASLDSSDAPTSLESSGSLDSLDGRVLAKAVVARENLPATHRAAMDGYAVRAADLFGASEGSPAYLDVVGHSAIDARPDVTLGPGQCLGIVTGGTLPEGADAVLMVEYAHDLGGGAIEAHRPVAPWENVMLRAEDAEEGRVVLPAGTLLRPQEVGLLAALGETAPLVHRRPRVAVISTGDELVPADATPRDGQIRDVNTHTLACLVRRAGAVPRCMGLVPDVLPALEAALRQGLETADVVLLSGGSSVGVRDLTVAALERIEGAELLCHGVAISPGKPLIVARVGEKLVWGLPGQVTSAQVVMHVLGMPFLRHLAGWQDAFDMSRWPSRRAVLARNTATRQGREDYIRVRLDPRPDDLPEAVPLFGKSGLLKTLVGSDGVVRIPAEVEGLERGALVDVLLFGER

SEQ ID NO: 15567 - protein, 145 aa, Triticum aestivum
MAAAALREQLNALLSSMFSSGLVDDQFQQLQMLQEDGGTPGFVAEVVTLFCDDADRIISELAALLEQPIVDFDKVDAYVHQLKGSSASVGAQKVKFTCMQFRQLCQDKNRDGCIMALAVVRNEFYDLRNKFQTMLQLEQQIQAQQ

SEQ ID NO: 15568 - protein, 261 aa, Mycobacterium tuberculosis H37Rv
MSRKPLIAGNWKMNLNHYEAIALVQKIAFSLPDKYYDRVDVAVIPPFTDLRSVQTLVDGDKLRLTYGAQDLSPHDSGAYTGDVSGAFLAKLGCSYVVVGHSERRTYHNEDDALVAAKAATALKHGLTPIVCIGEHLDVREAGNHVAHNIEQLRGSLAGLLAEQIGSVVIAYEPVWAIGTGRVASAADAQEVCAAIRKELASLASPRIADTVRVLYGGSVNAKNVGDIVAQDDVDGGLVGGASLDGEHFATLAAIAAGGPLP

SEQ ID NO: 15569 - protein, 531 aa, Sorghum bicolor
MATTATPQLLGGSVPQQWQTCLLVLLPVLLVSYYLLTSRSRNRSRSGKLGGAPRLPPGPAQLPILGNLHLLGPLPHKNLRELARRYGPVMQLRLGTVPTVVVSSAEAAREVLKVHDVDCCSRPASPGPKRLSYDLKNVGFAPYGEYWREMRKLFALELLSMRRVKAACYAREQEMDRLVADLDRAAASKASIVLNDHVFALTDGIIGTVAFGNIYASKQFAHKERFQHVLDDAMDMMASFSAEDFFPNAAGRLADRLSGFLARRERIFNELDVFFEKVIDQHMDPARPVPDNGGDLVDVLINLCKEHDGTLRFTRDHVKAIVLDTFIGAIDTSSVTILWAMSELMRKPQVLRKAQAEVRAAVGDDKPRVNSEDAAKIPYLKMVVKETLRLHPPATLLVPRETMRDTTICGYDVPANTRVFVNAWAIGRDPASWPAPDEFNPDRFVGSDVDYYGSHFELIPFGAGRRICPGLTMGETNVTFTLANLLYCYDWALPGAMKPEDVSMEETGALTFHRKTPLVVVPTKYKNRRAA

SEQ ID NO: 15570 - protein, 474 aa, ASPERGILLUS NIDULANS FGSC A4
MWSPFLEVAKALREGHVVEFITQKYNEYGWTFEQNVLGRSGISTIEPENLKALLATQFNDFCLGTREREFGPLLGQGIFTLDGAGWSHSRALLRPQFTRDQVADLDLMESHISRLIELVPKDGSAFDIQRLFFLMTLDSSTHFLFGESVHCMDEGNVLARSTVNNAQGFANAFNTALDYLNWRSVAGNFYWMITSKEFRDANKRVHEVVDYYVHQAIEAKRHPEKKEPGRYIFAEALAADNDNPKVLRDNMLNILLAGRDTTASLLSSAFFYLSRHPAVWEKLRRVIIEEFGDVQNPKGEITHAKLKDLPYLRYVLNEVLRLQPPVPLNLRVAVKDTSLPVGGGPDGKSPVFVEKDQPVLYSVYAMHRRKDLWGPDADSFRPERWEENAKHGWEYLPFNGGPRICLGQQYALTEASYTMVRLMQRFSKVENGEPGLDEPLIRATLTMSHENGVKVRFKLQHVRRKPSPLQTCTR

SEQ ID NO: 15571 - protein, 405 aa, Oryza sativa
  unsure (1)..(405): unsure at all Xaa locations
MALPLHDATTSPSDPDDLGGGGEEEEERLASKPLLSSPSTYPSAGTEEGVEELELDRRYAPYARRDAYGAMGRGPTWARRGRXRLAVGAAVLFPLRLAAGVLVLVAYYLVCRVCTLRVEEEEREGGGGGAAGEVEGDGYARLEGWRREGVVRCGRALARAMLFVFGFYWIREYDCRFPDAEDEHQEQSKELGRPGAVVSNHVSYVDILYHMSSSFPSFVAKRSVARLPMVGLISKCLGCIFVQRESKTSDFKGVSGAVTERIQRAHQQKNSPMMLLFPEGTTTNGDYLLPFKTGAFLAKAPVKPVILRYPYKRFSPAWDSMSGARHVFLLLCQFVNNLEVIHLPVYYPSEQEKEDPKLYANNVRKLMAVEGNLILSDLGLAEKRVYHAALNGNNSLPRALHQKDD

SEQ ID NO: 15572 - protein, 350 aa, Coffea canephora
MAEEEACLFAMSLASASVLPMVLKSAIELDLLELIAKAGPGAYVSPSELAAQLPTHNPEAPIMLDRILRLLATYSVLDCKLNNLADGGVERLYGLAPVCKFLTKNADGVSMAPLLLMNQDKVLMESWYHLKDAVLDGGIPFNKAYGMTAFEYHGTDPRFNKVFNQGMSNHSTITMKKILEVYRGFEGLKTVVDVGGGTGATLNMIISKYPTIKGINFELPHVVEDAPSHSGVEHVGGDMFVSVPKGDAIFMKWICHDWSDDHCRKLLKNCYQALPDNGKVILAECVLPEAPDTSLATQNVVHVDVVMLAHNPGGKERTEKEFEALAKGAGFKEFRKVCSAVNTWIMELCK

SEQ ID NO: 15573 - protein, 156 aa, Zea mays
MVSAKRLVQMAKKWQRMAATARRRIALAPPAKGAAEGSSPPCSTSPVAGKGHCVVYSADGRRFEVPLPYLDTAVFGVLLGMSREEFGFAGGDGRITVPCDAAVMEYVMCLLRRDASEEVVRAFLSSVVSRPCSHCGNGSLVQSTTGVRQQAAVSSF

SEQ ID NO: 15574 - protein, 165 aa, Capsicum annuum
MASQREENVYMAKLAEQAERYEEMVEFMEKVVAALDGGDELTVEERNLLSVAYKNVIGARRASWRIISSIEQKEESRGNEDHVTSIKNYRSKIEIELTSICNGILKLLDSKLIGSAATGDSKVFYLKMKGDYYRYLAEFKTGAERKEAAENTLSLISLLRILLMP

SEQ ID NO: 15575 - protein, 557 aa, Schizosaccharomyces pombe
MSKTLTITMLLFVSMAGWMFGADTGSIGGITNMRDFQSRFADRYNPVTDTYSYSSARQGLITGMVNVGSFFGCLISSPTTDRIGKRNSIIGFCVIYLIGVIIQVTAVPSWVQIMVAKIWTGLGIGALSVLAPGYQSEVAPPHIRGTIVVTYQLCVTAGIFIAACINMGTHKLYKTAQWRVSIGINLLWGIITLVGVSFLSESPRYLVSIGKDDEAIQVMCKNAELPPDSDIIQTEYKQIKSDCEAAVEGGPCTWPEIFGKEIRYRTFLGMAIMSFNQLTGCNYYFYYGTQVFKGTGMESPYLASLILDAVNFGCTFGGLFVLEYCGRRVPLIIGGVWQSICFFIYAAVGNRALTRKNGTSNHRAGAVMIVFSCLFIFSFAQTWGPAAYVIVGESYPIRYRSKCAAVATTSNWLWNFLISFFTPFITNSIGFKYGYIFASCNLCASIVTFLFAHESKGLTLEEINELYLSDAKPWMSRPKNLSEMAEAKEVEREETRPKGESARYLEHADSNSDSEDLSSSANNDVHEPVARQDPFNENEVEKSRTRPSQESYTTSSN

SEQ ID NO: 15576 - protein, 291 aa, Bradyrhizobium japonicum USDA 110
MKIRKAVFPVAGLGTRVLPATKAMPKEMLTIVDKPLIQYVYDEAREAGIEHFIFVTGRNKNVIEDHFDKMFELDATLAARGKKAEQEILAQNQPEAGAVSFTRQQAPLGLGHAVWCARDIVGNEPFAVVLPDELVLNTPGCLKQMIETASSLGDKSNLIAVEAVPDHLTHQYGICGVGKRTGKMFEVDGMVEKPAKGTAPSNLSITGRYILQPEIFKILETQERGAGGEIQLTDAMIGLARSQKFYGVEFEGERHDCGSKPGFLRANIAYGLKRPELRDGLIAEMKKYLGQ

SEQ ID NO: 15577 - protein, 257 aa, Vibrio cholerae
MRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 15578 - protein, 189 aa, Brassica napus
VNKDGTVRHFFHRPSKAYTTGTRKRRKVHTDSEVDGETRWHKTGKTRPVLTGGRVRGYKKILVLYTNYGKQKKPEKTNWVMHQYHLGTNEEEKEGELVVSKVFYQTQPRQCGGSVAAAATAKERPYLHGDSHHLGGGGGRHLHYHLHNVKGSGGSAVAGEYYNNIPAIISFNQTGIQNHLVNGSQPFIP

SEQ ID NO: 15579 - protein, 217 aa, Actinobacillus pleuropneumoniae serovar 1 str. 4074
MSETIENQACIVIAIAGASASGKSLIASTIYKELKEELNSDDIGIISEDAYYKDQTHLTMEERVKTNYDHPNSMDHHLLVEHLRQLKQGEAIEIPEYDYSEHNRKTTTKNFTPKKIIILEGILLLTDEEIRNEINVSIFVDAPLDICFIRRLQRDMLERGRTMDSVIAQYRKTVRPMFLQFIEPSKQYADIIVPKGGKNRIAINILKAQIKQLLSKR

SEQ ID NO: 15580 - protein, 189 aa, Glycine max
MVKAKQSQVWLRKSWWRVSWPGTLTLLLLLTCSFLILIPLALRILSTPHVNSSSALSKPNDLNSVPRNTHVSEGENNRVKRWVEVMSWEPRAFLYHNFLTKEECEYLINTATPNMLKSLVIDNESGEGIETSYRTSTEYVVERGKDKIVRNIEKRIADVTFIPIVGQYYEPHVDYFEEEFSLVNGGQRI

SEQ ID NO: 15581 - protein, 534 aa, Triticum aestivum
VVVDWGAAYLAPLLQFLTDACVVLFLIQSADRLIQCLGSFYITVKRIKPRLKSPALPDAEDPDAGYYPMVLVQIPMCNEKEVYQQSIAAVCNLDWPRSNFLVQVLDDSDDPTTQSLIREEVAKWQQTGARILYRHRVLRDGYKAGNLKSAMACSYVKDYEFVAIFDADFQPNPDFLKRTVPHFKDNDELGLVQARWSFVNKDENLLTRLQNINLCFHFEVEQQVNGVFLNFFGFNGTAGVWRIKALEESGGWMERTTVEDMDIAVRAHLHGWKFIFLNDVECQCELPESYEAYRKQQHRWHSGPMQLFRLCIPDIIKSKISVWKKFNLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAAAPPRELRHHPKTGSAPSMEALMVLKEQPSPKKEGKKQQKKPNRIYKKELALSLLLLTAAARSLLTKQGIHFYFLLFQGISFLLVGLDLIGEQVE

SEQ ID NO: 15582 - protein, 592 aa, Solanum tuberosum
KPPHTDVGCLPTVNAVTIHNPAVPFNSPESTLGRHLARRLVQVGVTDVFGVPGDFNLTLLDHLIDEPGLNFVGCCNELNAGYAADGYARARGVGACVVTFTVGGLSVLNAIAGAYSENLPLICIVGGPNSNDYGTNRILHHTIGLPDFTQELRCFQTVTCYQAVVNNLEDAHELIDTAISTSLKESKPVYISISCNLPGIPHPTFSREPVPFFISPRLSNKMGLEAAVEAAAEFLNKAVKPVIVGGPKMRVAKACDAFVELADASGYAVAVMPSAKGMVPEHHPHFIGTYWGAVSTAFCAEIVESADAYLFAGPIFNDYSSVGYSLLLKREKAIIIQPDRVTVGNGPTFGCILMKDFLAALGKRLKHNPTAYENYRRIYVPEGHPLKCEPKESLRVNVLFEHIQRMLSGDTAVIAETGDSWFNCQKLKLPKDCGYEFQMQYGSIGWSVGATLGYAQAAKEKRVIAFIGDGSFQVTAQDISTMLQCGQRTIIFLINNGGYTIEVEIHDGPYNVIKNWNYTGLVDAIHNGQGKCWTTKVRCEEELVEAIETATETKKDSLCFIEVIVHKDDTSKELLEWGSRVSAANSRPPNPQ

SEQ ID NO: 15583 - protein, 585 aa, Oryza sativa
MESNGGGGGSPKEAAVVVPSSGDATLGGHLARRLVQVGVSDVFAVPGDFNLTLLDYLIAEPGLSVVGCCNELNAGYAADGYARARGVGACAVTFTVGGLSVLNAIGGAYSENLPLICIVGGPNSNDYGTNRILHHTIGLPDFSQELRCFQPITCYQAVVNNLDDAHDQIDTAISTAIRESKPVYISVSCNLAAVPHPTFSRDPVPYFLSPRLSNQASLHAALDATLDFLDKAVKPVLVAGPKLAVAKAGEGFVDLADASRYGFAVMPSAKGLVPETLPAFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPDRQLRSARPGEPLRVNVLFKHIQGMIGGDEAVVAETGDSWFNCQKLRLPEGCGYEFQMQYGSIGWSVGALLGYAQAVQKRVVACIGDGSFQVTAQDVSTMLRCGQKSIIFLINNGGYTIEVEIHDGPYNVIKNWDYVGLVNAIHNGEGRCWATRVRCEEELEAAIATATGDKADSLCFIEVVAHKDDTSKELLDWGSRVSAANSRPPNPQ

SEQ ID NO: 15584 - protein, 264 aa, Dianthus caryophyllus
MLNFGATARNGVVSTRRWKSDTCIDLGPSDVRSEAHVLAVDDSLIDRKVIERLLKTTSCKVTVVDSGMRALEFLGLDAEQRTSVVDGLKIDLIITDYCMPGMTGYELLKKIKESSTFKETPVVIMSSENVIARIDRCLEEGAEDFILKPVKLSDVKRLRDYMTNKYDKSNSRVISGTNKRKQMDGSDQSYDSSSSSSSSSSLSLSPISTQSQPLISPSSSTPSSPCGPLDSNSMPSSPSGPSDTPSRRRRMAVDVDDDQTAVMP

SEQ ID NO: 15585 - protein, 750 aa, Eremothecium gossypii
MNQVPQDCLQPGIILTVGSHEVKIIQYLTSGGFAQIYSCEVLSPGPIQGSLACLKRVHVPDKPSLNTLRAEVDAMKMLKGHRHVVSYIDSHAAKSPRHDGTYEVYLLMEYCLRGGLIDFMNSRLQTRLSEFEVLKIMSHVAQGIMAMHALVPPLIHRDIKIENVLISGDGDFKVCDFGSVSGVIRPPKNAYEFNYVQHDILKNTTAQYRAPEMIDLYRALPVDEKSDIWALGVFLYKVCYFTTPFEKVGENAILQAKFQFPSYPQYTDRLKNLISVMLSEHPVQRPNICQVLEEVSRIQGVPCPLPNFYLERMKHGACTPVHHSASQPALPLATHQFSTSTPMVTHPQPPANQMSPLPHGIQPITSNMVYMMHNTTPNIKDIPRENPAATIQKNALYSMSGSEHLSALSSDMHFNRPQLENSHTFSGVGPRSSSNPIKIPRNEIQKFLSGTPPTSAKKPTYVDSETQTGDIITSNKSGSRPFAMSLSPLSSPELFSEQSTGNSLLGRLSRKTIRSPTSDKGSNPLKSKSSVGDDLASLLSSPSRNLSFPAQSSKSSKRNSADLSSRKSPVLNKSRIAMSYSGPEKSSATGLESSSSSLFGSQNGEHRPPSSTDRHKSNSTSFRLVPTKKGQTSIQERVHKLLATSAQEDVSKKASKKTTNSATSAKLEHQKGDEQSISTGSMSKIDAISMDLSSIAAGNVSKFQFTSVENVLKAAANGSVTAGKKPTTSETSKSAVSASATNSRKAPNCK

SEQ ID NO: 15586 - protein, 210 aa, Triticum aestivum
GRVGLFAIIYTWSLAGIVPSRSATPASISVQLVPACHLSQPFSTAGMEASGTSNMKFAMNGCILIGTLDGANVEIREEVGEENFFLFGAHAPEIAGLRQERAEGKFVPDPRFEEVKEYVRSGVFGTSNYDELMGPLEGNEGYGRADYFLVGKDFPSYIECQQKVDEAYRDQKLWTRMSILNTAGSPKFSSDRTIHEYAKDIWGISPVIMP

SEQ ID NO: 15587 - protein, 400 aa, Chlamydia trachomatis
MDFRWFMKRNPHFVSLTKNYLFADLQKRVAQFRLENPQHTVINLSIGDTTQPLNASVAEAFASSIARLSSPTTCRGYGPDFGLPALRQKLSEDFYRGFVDAKEIFISDGAKVDLFRLLSFFGPNQTVAIQDPSYPAYLDIARLTGAKEIIALPCLQENAFFPEFPEDTHIDILCLCSPNNPTGTVLNKDQLRAIVHYAIEHEILILFDAAYSTFISDPSLPKSIFEIPDARFCAIEINSFSKPLGFAGIRLGWTVIPQELTYADGHFVIQDWERFLSTTFNGASIPAQEAGVAGLSILPQLEAIHYYRENSDLLRKALLATGFEVFGGEHAPYLWVKPTQANISDRDLFDFFLREYHIAITPGIGFGRSGSGFVRFSSLGKREDILAACERLQMAPALQS

SEQ ID NO: 15588 - protein, 243 aa, Oryza sativa
  unsure (1)..(243): unsure at all Xaa locations
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAVRLPGRTDNEIKNYXSRQSCRKLLGRGIDPVTHRPVNAAVATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 15589 - protein, 337 aa, Zea mays; identical to SEQ ID NO: 3085

SEQ ID NO: 15590 - protein, 405 aa, Glycine max
  unsure (1)..(405): unsure at all Xaa locations
MQLLKKVVKSIRMANLSIVGSHAVNGVSKLHLDTLKMNTFKDFYELWPEKFQYKTNGVTQRRWMXVSNPSLCALISKWLGTEAWIRNADLLTGLRDLVDNTDFHQEWKMVKKVNKMRLAEYIETMSGVKVSLDAMFDVQVKRIHEYKRQLLNILGIIHRYDCIKNMDKNDRRKVVPRVCIIGGKAAPGYEIAKKIIKLSHAVAEKINNDTDIGDLLKLVFIPDYNVSVAELVIPGADLSQHLSTAGHEASGTGSMKFMMNGCLLLATADGSTIEIIEEIGSDNLFLFGAKVQEVAELREKGSTLKVPLQFARVLRMVRDGYFGHKDYFESLCDTVEIGNDFYLLGPDFGSYLEAQAAADKAFVEPEKWIKMSILSVAGSGRFSSDRTIQDYAERTWKIDPCRCPL

SEQ ID NO: 15591 - protein, 447 aa, Sorghum bicolor
MAPSKARQKRSLPQITTIAGTGPIANSQPASSTLTKEVDQQEEQCLKEPKIPPLPPITVNVVPQQGLGCEVVEGLLVPSRKREYKSNGKYTVGNHPIYAIGFNFMDVRYYDVFATASSNSVTVYRCLENGSFGLLQAYVDEDKDESFYTLSWTINKVDRKPLLVAAGNNQIIRIINCAGEKLAKSLVGHGGSIHEIRTHASKHSLIISASKDESVRLWNVHTGVCILIFAGVGGHRHDVLSVFANSNKCQVNLPKPLEMLLGRHKEFWVYVEKSYSWTDNPSKFPTRHIQFPVLSAAVHSEFVDCTRWLGDLILSKSVENEILLWEPKPDKNKPGEGSVDILQKYPVPQCTLWCMKFSCDFHFNQLAVGNSKGEIYVWEVQSCPPVLIDRLSNKECKSPIRQTAVSVDGSTILGAGDDGTIWRWDEVSPSTSKTKPIQAAVATDANA

SEQ ID NO: 15592 - protein, 60 aa, Triticum aestivum
  unsure (1)..(60): unsure at all Xaa locations
ERVRRWAPDRQDRFVRRFADALAHPKVSHXLRVIWIDFLSKCDKSCGLKVVNLLYVEPFM

SEQ ID NO: 15593 - protein, 577 aa, Oryza sativa
MATTPASLAAAAAAATAAPEPRGIRPPRAPVHRLRLRHHATRVGCSTVSVSTRPATTTTTTTTRSQPPPPQPPQAAEPLQRRWGPTERRKGADILVEALGRCGVRDVFGYPGGASMEIHQALTRSPAIRNHLLRHEQGEAFAAVRETPIVELTRSITKHNYLVLDVDDIPRVINEAFFLATTGRPGPVLVDIPKDIQQQMPVPSWDAPMRLPGYISRLPKPPSAKLLDELTGIPVTTTLMGIGNFPSDDPLSLRMLGMHGTVYANYAVDNADLLLALGVRFDDRVTGKVEAFASRAKIVHVDIDPSELGKNKQPHVSICADVKLALQGMNATLEQQQRKNLDFSAWRSELEKKKAEFPLGYRTFGEEIPPQYAIQVLDEVTNGEAIVATGVGQHQMWATQHYTFRRPRQWLSSAGLGAMGFGLPAAAGAAVANPGATVVDIDGDGSLLMNIQELAMVRVENLPVKVMVLNNQHLGMVVQWEDRFYDANRAHTYLGNPAANGGGEVYPDFVAIAGGFGIPAARVTRKGEVRAAVEEMMAAPGPYLLDVVVPHQEHVQPMIPSNGAFKDIIVDGGGRRT

SEQ ID NO: 15594 - protein, 528 aa, Vibrio cholerae
MDLILLSAAFLAGFIALKCHLPPLVGFLIAGFALNAYGFTSNDTLSLLADLGVTLLLFTIGLKLEVKTLLAKEIWAGSTIHNLLSTALFTLLLLIFKQLGLDSLADLSFDKLILIGFALSFSSTVFAVKSLQEKGEMNATYGTLAIGILVMQDIFAVVFLTASTGKLPEWYAIGLFVLPLLRPLFYELLDWVGHGEMLVLFGIFFALVVGAGSFQLVGMKPDLGALILGMMLASHHKASELSKALFNLKELFLVCFFLNIGLSAHPTTTGIMLALLLLLLLPIKGVLYFWVIHQFHFRVRTSLLASLSLFNFSEFGLIVGGLAFKMGWINSDILVALAISVPLSFILAAPIERKGHAIYQRSAKWLKEQAAESLHTRDRLIDPGEAQVLILGMGRIGRGAYEELTSRHGEICLGVEIREEAANSHREEGRNVISGDATDPDFWERIFDTGKVKLVLLAMPHHQANQIALEQLQKRHYQGQIAAIAEYPDQIESLLEHGAHAAFNIYSEAGTGFARHVCEQLKPNFTRR

SEQ ID NO: 15595 - protein, 465 aa, Nannochloropsis gaditana
YAEMGYWDANYTIKDTDVLALFRITPQPGVDPIEAAAAIAGESSTATWTVVWTDLLTACDVYRAKAYKVDSVPGTSDQFFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNTLLQTSLNINLPQGIFFEQDWASLRKTLPVASGGIHCGQMHQLLNYLGEDCVLQFGGGTIGHPDGIASGATANRVAMECVLLAKYEGKDYINEGPKILRAAAESCAPLRTALDLWKDIAFNYTSTDTADYVETTTKQ

SEQ ID NO: 15596 - protein, 373 aa, Oryza sativa (japonica cultivar-group); identical to SEQ ID NO: 6407

SEQ ID NO: 15597 - protein, 139 aa, Triticum aestivum
  unsure (1)..(139): unsure at all Xaa locations
PVQLNGTLHDVTNIHARKEEYLSTVTILQXFRQICARLKHMHSFXPPYAHNGVKPHNVLITQRKEQPHLGILMDFESARPERIAIILQSETLHLLEWAXQHCSXHFLAPELWECPPHADVDERTYVWSMGCTLYAMMYG

SEQ ID NO: 15598 - protein, 297 aa, Actinobacillus pleuropneumoniae serovar 1 str. 4074
MPTLFALKERIAQVVQEKNDPIVTAVATTLAEQQYNACFSAEQVKLWKRQFKCSSVELALACLPIAACYALVPISNFYVGAVAIGESGRFYFGANQEFNAQAIQQTVHAEQSAISHAWLAGETAITDMVVNYTPCGHCRQFMNELNSAKTLKIHLPHSQNNLLRQYLPDSFGPKDLNIEKVLFDQQTHSLPLRGDLLTQAAIQTAAQSYAPYSKSLSGIALQVGEQIICGRYAENAAFNPSFLPLQSALNYRRLSGKSDERISRIVMAESKGTTSHRQMSEALAESFLGLNLEYIEV

SEQ ID NO: 15599 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLRREEFGGELIDGGPWLEVKNPNTGKEIVIKEVIADAFLQQILLGPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 15600 - protein, 115 aa, Actinidia eriantha
MVPKPLSLLFLLLALSAAVVGGRKLVAPGGWRPIENLNSAEVQDVAQFAVSEHNKQANDELQYQSVVRGYTQVVSGTNYRLVIAAKDGAVVGNYEAVVWDKPWMHFRNLTSFRKV

SEQ ID NO: 15601 - protein, 486 aa, Oceanobacillus iheyensis HTE831
MSMYSQLDSQYINGVWKDGNGKATIQNTNPYSGEVIATYRAASLQDLDDAYETAQEVQKAWAKENPITVQRIMDKAVTYMEENHEEIVDIIIQEIGGTRLKAEFEIGLVTNMIKEASSFPMRMSGSILPSPIDGKENRVYRVPVGVVGVISPFNFPFFLSMKSVAPALATGNAVVLKPHEHTAITGGTMIAKIFEEAGLPKGVLQVVTTEISEIGDRFVDHPVPAAISFTGSTKVGKHIGEVASRNLKEVHLELGGNSALIVLEDADVDYAVSAGVFSRFTHQGQICMSANRIIVHEDVYDEFVQKYADKVKTLTCGDPADSSTIIGPLINERQVQNTVNLIEKGVEEGAHPLVRGQVNGNVVEPVIFTEVTPDMQIANEEFFAPVVAIMKVSSEEQAIAYANASSYGLSGAVHTSDVNRGAEVAKQLESGMIHINDGTINDEPNVAFGGVKNSGVGRLNGEWSLEAFTTTKWISIQHTKRQFPYS

SEQ ID NO: 15602 - protein, 479 aa, Oryza sativa (japonica cultivar-group)
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICLAINLLVPLRMPDDKLEVGDDAVHGEEAYALWGDGEMYDVTKHGSDAAVAPVVV

SEQ ID NO: 15603 - protein, 164 aa, Glycine max
  unsure (1)..(164): unsure at all Xaa locations
ASSMISSPAVTTVNRAGAGMVAPFTGLKSMAGFPTRKTNDGITSIASNGGTVHCVQVWPPFGKKKFXTLSYLPDLNDAQLANDVXYLLRKGWIPCLESDLDHGFMYREHNRSPSYYDGRYWTMWNLPMFGCADASHVSNELQDVYTAYPLGSIPFTLVDDARQI

SEQ ID NO: 15604 - protein, 334 aa, Thermotoga maritima
  unsure (1)..(334): unsure at all Xaa locations
NPLDLIAKRAYPYETEKRDKTYLALNENPFPFPEDLVDEVFRRLNSDALRIYYDSPDEELIEKILSYLDTDFLSKNNVSVGNGADEIIYVXXLXFDRSVFFPPTYSCYRIFAKAVGAKFLEVPLTKDLRIPEVNVGEGDVVFIPNPNNPTGHVFEREEIERILKTGAFVALDEAYYEFHGESYVDFLKKYENLAVIRTFSKAFSLAAQRVGYVVASEKFIDAYNRVRLPFNVSYVSQXFAKVALDHREIFEERTKFIVEERERXKSALREXGYRITDSRGNFVFVFXEKEEKERLLEHLRTKNVAVRSFREGVRITIGKREENDXILRELEVFK

SEQ ID NO: 15605 - protein, 135 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQA

SEQ ID NO: 15606 - protein, 928 aa, Thermobifida fusca
MTEPFRDPTLPPHERVRDLLARLTTEEKIGLLHQYQRPIPRLGIASFRTGTEALHGLAWHGPATVFPQAIGLASTWDPDLVQQVGAATAAEVLVFHTKNPATVGRNVWAPVVNPLRDPRWGRNEEGYSEDPWLTGVMAVSYARGLAGPHPHRMDTAPTLKHFLAYNNETDRCTSSSHLPPRVLHEYELPAFLPALREGVAVAVMPSYNLVNGRPAHLSPLINDVLRAAAPDELMVVSDAMAPGNLVDPQHYYDDHATAYAHALRAGIDSFTQDDDRAEATLAHLRDALDRGLITEEDLDRAATHILSVRVRLGEFDPEPLRRVDPDTVNSPAHQALARTAARRSIVLLKNDGILPLRDPRRIAVIGQLADTLMEDWYSGTLPYAITARAGLAERTETVFCEGVDRIALRTNEGYLTASADGTPMTITPAPGFGPVAESAAFDLFDWGGAWALRAVVNGRYVSEDENGHLTNDQPGPNGWEVRQTFRWQPDPNGTGVLQHIATGRYVAVGDNNTVTLTPDADSAAVFAIDTLRSGATEAAAIAATAEVAIVVAGDHPLVNGRETEDRTDLDLPAAQEKVLRAVRAANPATVLVLTSGYPFGIVWADEHIPAILWSAHGGQEYGRALADVLFGDADPTGRLTQTWYRSAAELPDLFDYDIIANDATYLYYLGSPLYPFGHGLSYTTFDYTDPEVHVTDDHVTVHVTVTNTGDRFGEEVVQCYTHQRVSRVKQPLRKLQGFARVALHPGETRRVRIDFPIHALAIWDVTRSRFVVEDAPRTVHLGRSAKDLRVCAPLNVPGEPIGPRPATRLHAADNDEYHGVVLCAAAKDRGDAVRATEPGAWIAFLDVDFTPAPKEAVICANTDQPGTLTLRIDNPISGPTVATADIPAATDHFDFTEVRIPVDSVTRRHDLYIVFEAAGTALSWIDLS

SEQ ID NO: 15607 - protein, 147 aa, Funaria hygrometrica
MDFPLFQILSFPDELEKSLNPQSQKYVRDTKAMVSTAVDVKELPDAYIFVADMPGLKSADMKVQLENDNVLVIGGTRKREEPDPKVKYIRMERNSGSFMRKFTLPQNSNLDKIAASCVDGILTVTVPKIPPPEPAKPRTIEVTMGNQ

SEQ ID NO: 15608 - protein, 380 aa, Zea mays
MAKLGPGQGLGVRGWRRASLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSSRS

SEQ ID NO: 15609 - protein, 536 aa, Zea mays
MAVAAPAAVSTGAGQGKEYPGGLTLYVLLTCAVAATGGLVCGYDIGISGGVTSMDAFLHKFFPSVYRKEQTARGGGSQYCKFDSQLLTAFTSSLYLAALAASFFVASVAHSLGRKWCMFGGGVSFLAGAALNAAAQDVAMLIVGRILLGIGVGFAGLSIPIYLSEMAPHHLRGTLNIGFQLMITVGIFSANLVNYGVDKIRGGWGWRLSLGLAAVPAAVITVGSLFLPDTPNSLIRRGYHEQARQVLARIRGADVDVADEYGDLVSASEASAAVRRPWLDVLGRRYRPQLTMAVLVPFFQQLTGINVIMFYAPVLFKTIGLGGDASLMSAVITGLVNIVATFVSIATVDRLGRRSLFLQGGCQMLVCQIVIGTLIGVQFGASGDGAAIPKASAATVVAFICIYVAGFAWSWGPLGVLVPSEIFPLEIRPAGQGINVAVNMMCTFAVAQAFLPMLCHLRFGLFYFFGGWVLVMTLFVAAFLPETKGVPVEKMGTVWRTHWFWGRFVADAGMDGRAGNRDSAFHKGKDIAIESRSRPV

SEQ ID NO: 15610 - protein, 605 aa, Glycine max
  unsure (1)..(605): unsure at all Xaa locations
MDETEVENPIFMEINSEDKRNENQEFASEKGEGSSVVFSREAPLMRKESRMSTPYCCNAKKLKSGAVTIDCDLGSNEKYGLEKKLCRQDRIELGRLFQSAVSSHDWELAESLILVADPQTLNDALCITLDSIWFLSTELELNGIMGFIKKIIANGAYDFTRAALRTSFLASCVSACQSXTMSLADTVTVMAQRLHERLQECNGDEVLKAEAGAKVQKFTEWALKCIGXHSRLQDDRENVIHSSAVEIQLRLSAFKMFLDLAGSRLTGKDFSEAFDAACFPLTLFSSSFDPGWAFGLSATVIQGLLGMLVEGGSGNVNQCFLEASRFGSTELVRILLQIAQRNSLDVDVDLALGFASHYGKIGTMECLVEEGNAIAFLGPLMRAAERGCMQVVEWFVQRGCRDMELCLALTAATSSCQVHIAAYLLPHVPQQVLAALSVEILKAAGERSGGSLDGVAFLLQSDFLGDPAATYAVADIIAKSEDEAVAPELKTFLKEHWSEGAYKEGLRLGQEHYMNLVRIIKWGESPICLRDLPAPLTVAIAYLPLYRECVKTGGCLFSQRLRGQLVEAARRVGNRVLDEVTHGRELVVVLEQHLPHFLLHPSRIA

SEQ ID NO: 15611 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRSDILEPGTLQGYDRDPRSMSKRAEDYLRSTGIADTVLFGPEPEFFLFDDIRFGSSISGSHVAIDDIEGAWNSSTQYEGGNKGHRPAVKGGYFPVPPVDSAQDIRSEMSLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 15612 - protein, 506 aa, Vibrio cholerae
MIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 15613 - protein, 405 aa, ASPERGILLUS NIDULANS FGSC A4
MTVINEEGHETGRYLAIDMGGTNLRICDVTLTEEKGAYTIEQDKYRLPIHLRKGKGVELWEFIAAKLEDFLAKHKLAREDGEKLPLAFTFSYPVTQDHIRHGVLQRWTKGFDISGVEGEDVVAHLEEVFEKRNVPVRLVALVNDTVGTLIASAYKNPAIKIGSIFATGCNAAYMEKVSRIPKIADHGSEFESDALVSINCEYGAFDNAHKVLPMTRFDEEIDQTSARPGQQAYEKMVAGMYMGELLRLLLLHLHESSGFFTDAEIDRLRGYGTMDSASLSRMEAGGSEAERMSDAKCILKDLYGIEATDEEARVCCLLGEIVCTRAARLYACGIAALCRKQGISECAVGVDGSTFEKYSQFRERAVDALGEILDWPEGQQLVKLVTAEDGSGVGSALIGAITLNQ

SEQ ID NO: 15614 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRSSLEEMLADKQYLKEGQ

SEQ ID NO: 15615 - protein, 647 aa, Pseudomonas fluorescens PfO-1
MLHIRSQSGNQECWMGQASSHAAGAEGSATKPLSMLVAAVGVVYGDIGTSPLYTLKEVFSGAYGVPVNHDGVLGILSLIFWSLIWVVSIKYMMFVLRADNQGEGGIMALTALARRAAAGRKRLRTLLVVCGLIGAALFYGDSMITPAISVLSAIEGLGLAFDGIDHWVVPLSLVVLVGLFLIQKHGTARIGILFGPIMVTWFLVLGALGVYGISHYPEVLHAMNPVWAVRFFMVHTGMGVAILGAVVLALTGAEALYADMGHFGRKPIARAWFLLVLPALVLNYFGQGALLLENPDAARNPFYLLAPSWALIPLVGLSTLATVIASQAVISGAFSLTRQAIQLGYIPRMYIQHTSSDEQGQIYIGAVNWSLMVGVVLLVIGFESSGALASAYGVAVTGTMLMTTILVSAVMLLLWKWPPILAVPVLIGFLLVDGLYFAANVPKIVQGGAFPVIAGIALFVLMTTWKRGKQLLVERLDEGALPLPIFISSIRVQPPHRVQGTAVFLTARSDAVPHALLHNLLHNQVLHEQVVLLTVVYEDIPRVPPSRRFEVEAHGEGFFRVILHFGFTDEPDVPQALKLCHLDDLDFSPMRTTYFLSRETVIASKLEGMARWREALFAFMLKNANGNLRFFNLPLNRVIELGTQVEM

SEQ ID NO: 15616 - protein, 322 aa, Brucella melitensis 16M
MHNFRELEMSLISIGTLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVAGFGAGHVSGDEADIIERYASRIPVVVASRTYGGRTATKTYGFHGSEIDLQTKGAMLAGWLSPPQGAVIAMGTTGSG

SEQ ID NO: 15617 - protein, 203 aa, Glycine max; identical to SEQ ID NO: 2850

SEQ ID NO: 15618 - protein, 405 aa, Photobacterium profundum
MTFVDNISHAVETLVQSSDTLFILLGAIMVLAMHAGFAFLEVGTVRQKNQVNALVKIIADFGFSAIAYFFIGYWVAYDVTFFSSAEQLSAINGYELVKFFFLMTFAAAIPAIISGGVAERARFYPMLVASFFIVAFVYPFFEGIMWNGNYGFQNWLTETFGFGFHDFAGSVVVHAVGGWIALVAVAMLGIRNGRYRGGRLIAFAPSNIPFLALGAWILTIGWFGFNVMSAQTMGSISGLVAVNTLMAMVGGILTSLFVGKNDPGFIHNGPLAGLVAVCAGSDLMHPIGALVTGAIAGALFVWLFTYIQNRLHLDDVLGVWPLHGVCGAWGGIAAGIFGSEAFGGLGGVSLASQVIGTLAGIAIAVIGAFIVYGIIKKTVGLRLTDEDEYKGADLAIHKIGSVSDD

SEQ ID NO: 15619 - protein, 310 aa, Prochlorococcus marinus str. MIT 9313
MGQTNQIQGSRFRYVLLILIALIWGSQFLLNDLALEVFTPQAVSWLRATIGFLTLSGFLLILPEAHDNPVSKISYWRQIIMIGFFEATLPFFLVAWGQQHVNSAIAAILMSLVAIFTLILVVLFVRSEPVTRGKFIGIALGFAGVVVLLWPQVSQSQQGNSLLGSAAILTAALSFSISLVLIRTLPEMGTPIKIARDILLCGAIELGALLLLLGQPLTHHPIESNVVLAMVAQGAFAGGLVYVLYVRLVGLAGATFAGFVNYLVPLVGVFLGVVFLQNKLSASAYASLLILALAVFASEWKPTRKLVGRQ

SEQ ID NO: 15620 - protein, 492 aa, Triticum aestivum
  unsure (1)..(492): unsure at all Xaa locations
NHYRSHMKNIQXARKRRFRLERQLATSEVPREQQINLIKDLERKETEYMRLKRHKICVDDFELLTIIGRGAFGEVRLCREKTSGNIYAMKKLKKSDMXLSGGQVEHVRAERNLMAEVASHCTVKLYYSFQDTEYLYLIMEYLPGGDIMTLLMREDTLTEPVARFYIAETILAIESIHKHNYIHRDIKPDNLLLDKNGHMKLSDFGLCKPIDCSKLSTLSEDEPMGDDNLKESMDVDSSLSETANGRRWRSQHEQLQHWQMNRRKXLAFSTVGTPDYIAPEVLLKKGYGMECDWWSLGAIMYEMLVGYPPFYSDDPITTCRKIVHWRNHVKFPDDSRLSPEARDLICRLLCDVDHRIGGAGADQIKAHPWFRGVAWDKLYEMEAAFKPQVNDELDTQNFMKFDEMDNSPPARTGSGPSRKAKLNSKDLSFVGYTYKNFDAVKGLKHADMQRSSSLTRPSIGAIFGSNGMESSREPNGKDTHMHTFSSGDPMSP

SEQ ID NO: 15621 - protein, 302 aa, Pseudomonas syringae pv. tomato str. DC3000
MHDLLNEILDEVRPLLGQGKVADYIPALGGVRPDQLGIAVYGNDGQVFSAGDAETLFSIQSISKVFSLVQAIGHSGEDIWQRLGHEPSGQPFNSLVQLEFEQGRPRNPFINAGALVICDINQARFAAPSLSMRDFVRRLCGNRSITSDSKVAESEYQHRSRNAAAAYLMKSFDNFHGDVEDVLRSYFHHCALSMNCIDLAKAFGFLANQGFCAHSGVQILTARQATQVNSIMATSGLYDEAGNFAYRVGLPGKSGVGGGIVAIVPERASVCVWSPALNAAGNSLVGMAALEKLSARVDWSVF

SEQ ID NO: 15622 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 15623 - protein, 291 aa, Haemophilus influenzae Rd
MAENRYELNKNLAQMLKGGVIMDVQNPEQARIAEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMSQEIRRIQNLREDELYVAAKDLQVPVELVQYVHKHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 15624 - protein, 405 aa, Halobacterium sp. NRC-1
MGPMETYVVTEPALVERLLVSDAAEFRKPEFQADAIDDLLGDGLLLSEGESWREQRGRANPAFSMARVAGFDADIAAHAADRVDDWPVGDTVDVEAAMTHITLDVILDVMLGVSLPEARVDAIGDALEPVGARFEPDPVRFAVPEWLPMPDDREYAAAVATLDDLVDDIVAAREGTASGGDGDDPMDLLSVLLRARDRGEQSLDRLRDEVMTTLLAGHDTTALTLTYTWFLLSEHPDVEARLHAELDGALDDGAQPTVAQLQDLDYLEWVLQESMRLYPPVYNVFRTPIEPVELAGSEVPAGAPIMLPQWAIHRSPDHWDDPEAFDPERWRPERRADRPRFAYFPFGGGPRHCIGKQLALLEAKLIVATVASDYRLRYEGDTPLSFVPSLTIHPEQEMRMRVEPR

SEQ ID NO: 15625 - protein, 471 aa, Ralstonia metallidurans
MQRIAHIYINGEFVTPHGDEWFDLYNPSTEEVIGQVRLGDAQDARRAIAAAQAAFPAWSRTTREERIAALHRMHRAVAAREDELMEAILLEYGAPQVRGRWMATYPADVIAQAIDTLESFAFEEHVGSAKVIQVPVGVAGLITPWNSNAGFICNKLATALAAGCTAVIKPSEMSAMQTQIVAQALHEASLPPGVFNIVNGRGEIVGEEIARNPGVAKISFTGSSAVGQHLVVTGAETMKRVTLELGGKSPTIVLPDADFATVMPLVLQAGFANSGQACIAGTRILVPRNRLTEFEHIAKEAVSHVRSGDPRDTDTDIGPMVSQKQWERVQNYIRIGQQEGATLLAGGEGRPDGMHAGWFVKPTLFTHANNQMRIAREEIFGPVLTIIPYDDEADAIAIANDTRYGLSALVLGTNLESCERVARQIDSGRVLVNTLAHEPRAPFGGFKHSGLGREMGRWGMSAYLEPKTLLT

SEQ ID NO: 15626 - protein, 405 aa, Arabidopsis thaliana
MPLSLQSPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLASSMGPASVELLSAGVEGYANQAKRVEELFGKIWPPPNV

SEQ ID NO: 15627 - protein, 217 aa, Pisum sativum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTSFAEREHTFFMETSALESLNVESAFTEVLTQIYRVVSKKALEIGDDPAALPKGQTINVGSRDDVSAVKKGGCCSA

SEQ ID NO: 15628 - protein, 421 aa, Oryza sativa
  unsure (1)..(421): unsure at all Xaa locations
MAATPGSSRPANVAAAAATEARFHSHPPQQDRRSGWAGCLSGLSCFGSQKGGKRIVPAARIPDGNASTSRGNAHQSGSNSNQNVALNLSLLAPPSSPASFSNSAIPSTAQSPNRFLSISANSPGGPTSNMFAVGPYANEPQLVSPPVFSTYTTEPSTAPLTPPPELTHATTPSSPDVPYARFLFSAMDLKTAGKDHNMPYLSTAYSGGSGLQASYPLYPESPSSSLISPASATPRTGLSSPIPEQEVPTAHWKTSRSACDFXYSRASPIPEQEVPTAQWKTSRSACDTPYSRNSPSNIFGLDSAASRNYMLDNNFFRPAASAQFYLDQAQQSFPYNNGGRISVSRDKQDAEEVEAYRASFGFSADEIVTTQAYVEIPDALDEGFSISPFGNNAPATEVDXPLFNXKVTTSPKKSADQLSND

SEQ ID NO: 15629 - protein, 713 aa, Bacillus sp. B1018
MKKFLKMTAAFSLGLSLAFGLFSPAQAAPDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTSDVYLKDAIKMWLDLGIDGIRMDAVKHMPFGWQKSFMAAVNNYKPVFTFGEWFLGVNEVGPENHKFANESGMSLLDFRFAQKVRQVFRDNTDNMYGLKAMLEGSAADYAQVDDQVTFIDNHDMERFHASNANRRKLEQALAFTLILARVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLTVGSGGAASNFTLAAGGTAVWQYTAATATPTIGHVGPMMAKPGVTITIDGRGFGSSKGTVYFGTTAVSGANITSWEDTQIKVKIPAVAGGIYNIKVANAAGTASNVYDNFEVLSGDQVSVRFVVNNATTALGQNLYLTGNVSELGNWDPAKAIGPMYNQVVYQYPNWYYDVSVPAGKTIEFKFLKKQGSTVTWEGGSNHTFTAPSSGTATINVNWQP

SEQ ID NO: 15630 - protein, 409 aa, Hordeum vulgare subsp. vulgare
MEPVFSLLEEAMPEPDSNPGRTSPPQLQAHVLAGGVRGAGGVGVGEIVGDGATELCFDKSMEEPSLLNVPTEPVANPDASTLHPNPTAEVSRKRRYDVHEEEEVVGVIPTPPAAGAVLDPVGYNAMLRRKLDAHLAAVAMWRTTRGICRQSSHDNRASQNPDSIQGSENHTGDASVQQLSSSSWEPSPSDDDMEGEAQTIGTMNISAEKVNKRKESNRDSARRSRSRKAAHTKELEEQVSLLRVANNSLMRHLADVSHRYVNTAIDNRVLKANVETLEAKVKMAEETMKRITSTNNFPQAISGMSSLRTHFSGSQLDGIFDTTLPTQNMSLNHFSTTATNFDVSSNYIPELAPAYQIHDQISSLHTQPMPCLDHHPRRMPFGIPSTLVPTPQRESTTLDSNEIGNMVMQ

SEQ ID NO: 15631 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 15632 - protein, 140 aa, Scenedesmus rubescens
VTTYKGTFRAAVPSGASTGIHEAVELRDGDKSQWMGKGVAKAVGNVNNDIAPALLGKDPTQQKEIDDAMIALDGTENKGKLGANAILAVSMAVAKAGAAEKGVPLYKYIAQLAGNSKLVLPVPSFNVINGGEHAGNGLAM

SEQ ID NO: 15633 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 15634 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 15635 - protein, 229 aa, Triticum aestivum
  unsure (1)..(229): unsure at all Xaa locations
MGEEANCDAVMEDGNGNGNGKAKENGHATAVVAMPDVKAKAEDAVVAPGDPRLQGISDAIRVVPHFPKQGIMFNDITTLLLRPGVFKDALDMFVERYRGMGIAAVAGIEARGFIFGPAIALAIGAKFIPLRKPKKLPGEVXISETYVLEYGTDCLEMHVGAIEPRERVLIVDDLVATGGTLCAAINLLERAGADVVECACLIGLPKFKDFYKLNGKPVYVLVESLEYEK

SEQ ID NO: 15636 - protein, 544 aa, Providencia stuartii
MTPGEIKRLYFIIRVFLSYGLDELIPKVKLTLPLRIGRFGFFWIKNQHKGKELGERLRLALQELGPVWIKFGQMLSTRRDLFPLAIADQLSLLQDKVASFDGKLARRYIEESLGGPLEQWFDDFDEKALASASIAQVHTAKLKENGKEVVLKVIRPDILPVIKADVKLMYRIANWVPLLPDGRRLRPKEVVREYEKTLIDELNLLRESANAIQLRRNFENSSMLYVPEVYADYCRENVMVMERIYGIPVSDIAALKAQGTNMKILAERGVKVFFTQVFRDSFFHADMHPGNIFVSYEHPEDPLYIGIDCGIVGSLNKEDKRYLAENFIAFFNRDYRKVAELHVDSGWVPADTNVEDFEFAIRTVCEPIFEKPLAEISFGHVLLNLFNTARRFNMEVQPQLVLLQKTLLYIEGLGRQLYPQLDLWKTAKPFLEDWVHSQVGIPAITQALKEKAPYWAEKMPEIPDLIYGALRQHKFLQSNIEQLSEQLKQQRNKQRKSQYLLGIGATLILCGSLFFISASNRMAIAFMSAGALSWIIGWYKSGKS

SEQ ID NO: 15637 - protein, 242 aa, Gerbera hybrid cultivar
MGKGRLELKRIENKINRQVTFAKRRNGLLKKAYELSVLCDAEVALIVFSTRGKLYEFSSTSSMLKTLERYEKCSFGPPEQRRPAAKEDLQEQSSYQEYMRLKERYDALKRLERNYYGEEIDSLTTSELESLERQLHCSLKQIRTIRTQSLLDKLYEQQKMEHQLYESNKTLRLRLDEEGQAEALQWDAHAHANGMVYAHQHQVSQPMRDTFYHPTGCETTLQIGYQSEQMSAVNHQMQGWPA

SEQ ID NO: 15638 - protein, 135 aa, Streptomyces coelicolor A3(2)
MSYDVEKPDEQWRAELAPAEYAVLREAATEPAFTGEYTDTKTEGVYSCRACGAELFTSTTKFESHCGWPSFYDPRDTDAVELIEDRSHGMVRTEVRCARCGSHLGHVFKGEGYPTPTDQRYCINSISLRLEPKAG

SEQ ID NO: 15639 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 15640 - protein, 357 aa, Oryza sativa
MSSSSSLYKQLGLGAGSPVSASHLLLLVLGAGFLALTVFVVHPNEFRIQSFFSGGCGRPGTDAATAAVAASPVKNVSGGASNAAAATTAARSPDNDVRVLIGIQTLPSKYERRNLLRTIYSLQAREQPSLAGSVDVRFVFCNVTSPVDAVLVSLEAIRHGDIIVLDCAENMDNGKTYTFFSTVARAFNSSDGEGSGSGSPPPPRYDYVMKADDDTYLRLAALVESLRGAARRDAYYGLQMPCDRENFYPFPPFMSGMGYALSWDLVQWVATAEESRRDHVGPEDMWTGRWLNLASKAKNRYDMSPRMYNYRGASPPSCFRRDFAPDTIAVHMLKDAARWAETLRYFNATAALRPSHL

SEQ ID NO: 15641 - protein, 197 aa, Brassica napus
MGRKKLEIKRIENKSSRQVTFSKRRSGLIEKARQLSVLCDASVALLVVSSSGKLYSFSAGDNLVRILDRYGKQHADDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 15642 - protein, 322 aa, Deinococcus radiodurans
MPASLPRLALIHTGGTIASRPSPDGRGLTPQTPPALPGLEGVQVSEHQPFNLPSPHVTPAHMQQLAHLIEQLAGGHDAVVVTHGTDTLEETAFFLHLCLPAGLPVVLTGSMRHAEEVSWDGPGNLLDAAQVALCPQTAGRGPLVVFGGDIFDARTVTKVHTSAVDAFGGYPGPIGRIDRTAAGPQVHYFARPEPRPTFRPVTLERRVEILYAYAGWQGEGYAGALERADGLVIAALGTGNLPPELLPLIAATDKPVVLATRTHAGPILPVYGYAGGGATLVEAGAIPASFLNAHKARLLLLVLLNLGASREDIRRVFTQGVF

SEQ ID NO: 15643 - protein, 523 aa, Datisca glomerata
MPAVGGIVVGGSKKEYPGNLTPYVTITCIVAAMGGLIFGYDIGISGGVTSMDSFLKKFFPAVYRKKELDSTTNQYCQYDSQTLTMFTSSLYLAALLASIVASTITRKFGRRLSMLFGGILFCAGAIINGFAQAVWMLILGRMFLGFGIGFSNQSVPLYLSEMAPYKYRGALNIGFQLSITIGILVANVLNYFFAKIRGGWGWRLSLGGAMVPALIITVGSLLLPDTPNSLIERGNRDEARSKLQRVRGVDDVDEEFNDLVAASEESKQVEHPWTNLLRRKYRPHLAMAILIPFFQQLTGINVIMFYAPVLFNTIGFGSDASLMSAVITGCVNVAGTLVSIYGVDKWGRRFLFLEGGFQMLICQAVVAAAIGAKFGVNGNPGELPKWYAIVVVLFICIYVAGFSWSWGPLGWLVPSESFPLEIRSAAQSINVSVNMIFTFAIAQIFLTMLCHLKFGLFIFFAFFVVVMSIFVYFFLPETKGIPIEEMGRVWKSHWYWSRFVTDADYTIGSGVEMGKGAQELKNI

SEQ ID NO: 15644 - protein, 165 aa, Zea mays
MSIEKIWAREILDSRGNPTVEVDLHTAKGLFRAAVPSGASTGIYEALELRDGDKQRYLGKGVLKAVDHINTTIAPVLISSGLSVVEQEKLDNLMLDLDGTENKSKFGANAILGVSLAVCKAGAAERELPLYRHIAQLAGNSDLILPVPAFNVINGGSHAGNKLAM

SEQ ID NO: 15645 - protein, 628 aa, Nostoc punctiforme
MKFSWKVVVLWTLPALVIGFFFWQGAFAGAPTDMSKNAANTRMTYGRFLEYLDGDRVSSVDLYEGGRTAIIEARDPDIENRIQRWRVDLPVNAPELISKLKEKDISFDAHPMRNDGAIWGLLGNLVFPVLLITGLFFLFRRSSNLPGGPGQAMNFGKSKARFQMEAKTGVKFDDVAGIEEAKEELQEVVTFLKQPERFTAVGARIPKGVLLVGPPGTGKTLLAKAIAGEAGVPFFSISGSEFVEMFVGVGASRVRDLFKKAKDNAPCIIFIDEIDAVGRQRGAGIGGGNDEREQTLNQLLTEMDGFEGNTGIIIIAATNRPDVLDSALLRPGRFDRQVTVDAPDIKGRLEILEVHSRNKKLDPSVSLDAIARRTPGFTGADLANLLNEAAILTARRRKEAITLREIDDAVDRVVAGMEGTPLVDSKSKRLIAYHEIGHALVGTLLKDHDPVQKVTLIPRGQAQGLTWFTPNEEQGLISRSQLKARITGALGGRAAEEVIFGAAEVTTGAGGDLQQLSGMARQMVTRFGMSDLGPLSLESQQGEVFLGRDWTTRSEYSESIASRIDGQVRAIVEECYDNAKKIVRDHRTVTDRLVDLLIEKETIDGEEFRQIVAEYAEVPEKQQYVPQL

SEQ ID NO: 15646 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILIQCLEREGVDNVFAYPGGASMEIHQALTRSDRITNVLCRHEQGEIFSAEGYAKASGRVGVCIATSGPGATNLVTRLDDAMMDSITLIAITGQVPRRMIGTDAFQETPIVEVTRAITKHNYLVLDIKDLPRVIKEAFYLARTGRPGPVLVDVPKDIQQQLAVPDWDSPMSITGYISRLPPPVEEYKMIPVLRAIQSATKPIIYYGGGCLDARNELREFAARTGIPLASKFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGANRTMLDTPGPYLLEVMVPHIEHVLPMIPGGATFKDIITEGDGSVKY

SEQ ID NO: 15647 - protein, 746 aa, Zea mays
  unsure (1)..(746): unsure at all Xaa locations
GNTSQRFADLGGYYLSDHTKCALMSSAYVHLHCKDYLKFTKDISSLSQRVLLSGPTGTDIYQEYLVKALAKNFGARLLTVDSSMLFGGQTSKEPETYKKGDRVRYIGSVQSTGVILDGQSPPDFGSQGEIFLPFEENRSSKVGVRFDKKILGGNDLGGNCEVDHGLFCPVDSLCLDIPGWEVTSKHPLDVIFEFISEEIRHGPFILFLKDTEKICGNNDYYHGLKSKLKHFPAGAFIIGSQIQPANRKEKAKGSSPFLSKFPYSQTILDLALQDIDAINGNNKETSKAAKHLIKLFPNKVILEAPQDEMELSRWNQMLNRDIEVLKGNANISKMRSFLTRVGLECTDLEAILVKDRVLTNECIDKIIGFALSHQLKNCTNPDPPLSNVQFVLSSESLKHGIDMLESIQSGSKSSTKRKSLKDIATENEFEKRLLADVIPPHEIGVTFEDIGALESVKDTLKELVMLPLQRPELFNRGQLMKPCKGILLFGPPGTGKTMLAKAVATEAGANFINISMSSISSKWLGEGEKFVKAVFSLASKIAPSVIFVDEVDGMLGRRENPGEHEAMRKMKNEFMVNWDGLRTKEKERVLVLAATNRPFDLDEAVIRRLPRRLMXNLPDASNRRKILSVILAKEDLADDVDLEAIANLTEGYSGSDLKNLCVTAAHRPIREILEKEKKERASAETENRPLPLSHTSNDVRALRISDFIHAHEQVCASVSSDSSNMNELVQWNDLYGEGGSREKDNG

SEQ ID NO: 15648 - protein, 339 aa, Oryza sativa (japonica cultivar-group)
MPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 15649 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTCQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 15650 - protein, 267 aa, Flavopunctelia flaventior
NDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKPDIEIISHASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDLKGIMSYSEDALVSTDLNGDNHSCIFDATAG

SEQ ID NO: 15651 - protein, 181 aa, Triticum aestivum
  unsure (1)..(181): unsure at all Xaa locations
MAPAVMASSATTVAPFQGLKSTAGLPVSRRSSGSLGRVSNGGRIRCMQVWPIEGIKKFETLSYLPPLSTEALLKQVDYLIRSKWVPCXLRFSKVGFRLPVSTTSSPRVITNGRYWTMXKLPYVRCTDAXTQVLNEVXEEVKKEYPDAYVRRNRASTTCAQVQCVSXFIAFRPPGCEESGKA

SEQ ID NO: 15652 - protein, 389 aa, Enterococcus faecalis V583
MSTKDVKELAIEQAKKFGGKLEVCPKVPIETKADLGIAYTPGVAAVSSAIHEKKERAYELTTKKNTVAVISDGSAVLGLGNIGPEAAMPVMEGKAALFKRFAGVDSIPLVLDTQDTEEIIQTVKFLAPTFGGINLEDISAPRCFEIEQRLIDELDIPVFHDDQHGTAIVVLAALYNSLKLINKKIEDIHVVINGGGSAGLSITRKFLAAGVKHIIIVDRAGILSETDTALPPHHAEIAKLTNREHRTGDLATALEGADVFVGVSAPGVLKPEWIQQMNEQPVIFAMANPVPEIFPDEALAAGAYIVGTGRSDFPNQINNVLAFPGIFRGALDARAKKITIEMQIAAAKGIAKLIPDNELTPTNIIPDPFQEGVAKVVAESVRNAVKETN

SEQ ID NO: 15653 - protein, 293 aa, Bacillus circulans
METGTSRVKRGMAEMQKGGVIMDVMNAEQAKVAEAAGASAVMALERVPSDIRAAGGVARMADPTVLEEVMKVVSIPVMAKARIGHIVEARVLEALGADYIDESEVLTPADEVFHIDKKDFTVPFVCGAKDIGEALRRINEGASMLRTKGEPGTGNIVEAVRHMRLIQSQIRKIQSLAKDELYAEAKNLGAPYDLVLYIHENGKLPVVNFAAGGVATPSDAALMMELGADGVFVGSGIFKSDSPEKFARAIVEATTHYKDYKLIAEVSKNLGAPMKGIEISKLHASERMQDRGW

SEQ ID NO: 15654 - protein, 354 aa, ASPERGILLUS NIDULANS FGSC A4
MAPSINEIPISDSPSACRVGINGFGRIGRNVLRVALARNDIQIVAINHTCTSVQDLIYLIRYDSSMGKLSPDIPIHAISETQISVNGRPIALTSERDLKKLNWAALGAEYVVECTGKFTKRELAQDHITYGGAKRVVISAPSSDSPTYVYGVNADEYRANEETRVISCASCTTNCVTPVLKVLQREFGIAQGFLTTVHAATKSQTVLDGYSKKNRRLGRSVFDNIIPTTTGAAKAIASVLPELTGKVTGASIRVPTPNVSLIDLTVSTETPTSLAEILAAFRRAAKNELAGVLSVSDEVLVSSDYLGDSHSAIVDAAACSELNPTFFKIMAWYDNEWGYSSRLLDLTRHIAHNE

SEQ ID NO: 15655 - protein, 531 aa, Triticum aestivum
  unsure (1)..(531): unsure at all Xaa locations
RPTRPVPKYTRKYGWMSLGGILLCMTGSEAMFADLGHFSYSAIQLAFTSLXYPALILAYMGHAPYLSKHHDFDSNSQVGXYIPFSDKAIWPVLVLAILASLVGSQAIISGTFSIINXSQSLSCFPRVKVVHTSXKIHGHIYIPEINWLLMILCIAVTVGFRHTKRVGNASGLXAVITVMLVTTFLTSLVIMVCWHKPPLLALGFLLFFGSVEALYFSASLIKFLEGAWLPILLALILMAVMLVWHITTIKKYEFDLQNKVTLEWLLALGDKLGMVRVPGIGLVYTDLTSGVPANFSRFVTNLPAFHKVLVFVCVKSVPVPYVFPAERYLVGRVGPPGHRSYRCIVRYGYRDVHQDVDSFETELIESLAMFIKLNAXSYRCSEVSQSEQLEEXSRGLTVIGSNTLRDHAXSYDLQDSVQHSAASVEVADSPGGTGLEYNSSKQVRFFIDSLVVSPEADKQVAEELEALAAAREAGTAFILGHSHVQCKPGSSVVKKLTVVGYNFLRRNCRGPDVVLRVPPASLLEVGMVYVL

SEQ ID NO: 15656 - protein, 316 aa, Magnetospirillum magnetotacticum
MGAISTRRAGCSRRPPTPWIDLSTGINPVPYPLPPLEASALHRLPSPADLARLKSVAAAAYGAPGPDHVAAAPGTQILIETLPRLVPRARVAVIGPTYAEHAAAWTRSGHEVRIVGALSEVEGAEIVVAVSPNNPDGRVVTAGALLRATGGRGLAVLDQAFVDLEPVEAAAPEPGLVVLRSFGKTYGLAGLRLGFALAEPALVRRIEAALGPWAVSGPAIAAGCAALSDDEWRRTAASARCQDAERLDRMILRAGGRILGGTALFRTATFEDGPELFHRLGEAGIYVRRFPEFPERLRFGLPPDKAAWCRLSRILK

SEQ ID NO: 15657 - protein, 473 aa, Pyrobaculum aerophilum str. IM2
MNVRAQITMAMNLDKCIGCHTCSVTCKNVWTNRAGAEYMWWNNVETRPGPGYPRQWEDQNKYNGGWALDGGKLKLKIELTKNYKPPSLKDYYEPWTYDYEALFSDKQTDQQPVARPISLITDEPMDVAYGPNWNDDLAGTDYILEDPNLDGLQREIYAQFKDVFMMYLPRICNHCLNPSCLAACPRKAIYKREEDGIVLIDQNRCRGYRYCVAACPYKKVYYNWKTGKSEKCILCYPSVEAGQPTVCSLTCVGKIRYMGVLLYDADKVLDVAATPDPAQLVRRFIDEVLLDPFDPAVIEAARKNGIPDYWITAAQRSPVYKIVKKWKVGFPLRPEFRVLPMVFYVPPLSPVVTTFEKTYGAQIADIFPKVSELRIPIKYLANMFTGGDTALIESALKKLIAVRIYERAKNVAEPGLADKAKAALAEAGLSEADAEEMYRLFALARYEDRFVIPTNPKRYAAQPQIMRGTVGLP

SEQ ID NO: 15658 - protein, 523 aa, Glycyrrhiza echinata
MLVELAITLLVIALFIHLRPTLSAKSKSLRHLPNPPSPKPRLPFVGHLHLLDKPLLHYSLIDLSKRYGPLYSLYFGSMPTVVASTPELFKLFLQTHEASSFNTRFQTSAIRRLTYDNSVAMVPFGPYWKFIRKLIMNDLLNATTVNKLRPLRSQEIRKVLRVMAQSAESQVPLNVTEELLKWTNSTISRMMLGEAEEIRDIARDVLKIFGEYSLTDFIWPLKKLKVGQYEKRIDDIFNRFDPVIERVIKKRQEIRKKRKERNGEIEEGEQSVVFLDTLLDFAEDETMEIKITKEQIKGLVVDFFSAGTDSTAVATDWALSELINNPRVFQKAREEIDAVVGKDRLVDEADVQNLPYIRSIVKETFRMHPPLPVVKRKCVQECEVDGYVIPEGALILFNVWAVGRDPKYWDRPTEFRPERFLENVGEGDQAVDLRGQHFQLLPFGSGRRMCPGVNLATAGMATLLASVIQCFDLSVVGPQGKILKGNDAKVSMEERAGLTVPRAHNLICVPVARSSAVPKLFSS

SEQ ID NO: 15659 - protein, 591 aa, Rhodobacter sphaeroides
MTTEEAFVKVLQMHGIEHAFGIIGSAMMPVSDLFPKAGITFWDCAHETNAGLMADGFTRSTGKMSMAIAQNGPGVTGFVTPVKTAYWNHTPLLLVTPQAANKTIGQGGFQEMEQMRLFADCVCYQEEVRDASRIPEVLNRVILQAWRNSAPAQINIPRDMWTQVIDVELPQIVAFERPAGGEEAVAEAARLLSGARFPVILSGAGVVLSGAIPDLARLAERLDAPVASNYQHNDSFPGSHPLAVGPLGYNGSKAAMELIARADVVLALGTRLNPFSTLPGYGIDYWPREARIIQVDINADRIGLTKKVTVGIQGDAAKVARAILAQLGEGAGDAGREERRHLVAQTKSRWAQELSSLDHEEDDPGTEWNAGARTRDADLMSPRQAWRAIMQAVPAEAIVSSDIGNNCAIGNAYPSFEAGRKYLAPGLFGPCGYGFPAILGAKIGNPDTPVIGFAGDGAFGISMNEMTACGREDWPAITMVIFRNYQWGAEKRNTTLWYDNNFVGTELDRDTSYAAIARACGAHGVQVRSQSELTAALHEAVERQMKARETTFIEVLLNQELGEPFRRDAMKKPVVVAGIDPADMRPQKGAA

SEQ ID NO: 15660 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 15661 - protein, 577 aa, Zea mays
MPSEYLLVSAEPSASMTAKEVKFSEAMSSMPRRWRPRVRGRVGGRVGGAAMAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSAWFKASFPAPAYAVDPAASTPPQADFVWRIILMLGAMPAALTYYWRTKMPETVEISAGAAEEGAAAATATATEPAPASASASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAALEDPSLRTRACDVIALL

SEQ ID NO: 15662 - protein, 310 aa, Vibrio vulnificus CMCP6
MKVAVIGAAGGIGQALALLLKNRLPAGSDLALYDIAPVTPGVAADLSHIPTHVSIKGYAGEDPTPALEGADVVLISAGVARKPGMDRADLFNVNAGIVKSLAERIAVVCPNACIGIITNPVNTTVPIAAEVLKKAGVYDKRKLFGVTTLDVIRSETFVAELKGQDPGEVRVPVIGGHSGVTILPLLSQVEGVEFSDEEIAALTKRIQNAGTEVVEAKAGGGSATLSMGQAACRFGLALVKALQGEEVIEYAYVEGNGEHASFFAQPVKLGKEGVEEILPYGELSDFEKAALDGMLETLNSDIQIGVDFVK

SEQ ID NO: 15663 - protein, 422 aa, Glycine max
MGQDTKNYNNIASSPLLEPLPSSNSKRASKLQTLGNIIVTVVGTGVLGLPFAFRIAGWVAGSLGVAIVGISTYYCMLLLVMCREKLASEEPLGESNTYGDLGYRSFGTPGRYLTEVIIVVAQCAGSVAYFVFIGQNLYSVFQGQGLSMASYIFMLVPVEIGLSWIGSLSALAPFSIFADVCNVVAMGIVVKEDIQRAFGKGFSFGQRTMITSNIGGLPFAAGMAVFCFEGFGMTLALENSMQDRRKFPILLAQTFGGITLVYILFGFCGYMAFGEETRDIVTLNLPRNWSSLAVQVGLCVGLAFTLPIMLHPINEIFEGKLKIILRNNNDSTGLENICMYISRAIVVVGLAVLASFVPEFGVYASFVGSTLCAMLSFVMPATFHLKLFGSSLPIWQKALDSIVLLSGLFFAFYGTYNTIVGV

SEQ ID NO: 15664 - protein, 181 aa, Glycine max
  unsure (1)..(181): unsure at all Xaa locations
LSRKYARIIQKIGFPAIFKHFKIQNIVGSCTCKSTIRXEDLAYSHDAFSSYKPQLFPGLIYRMKQPKIVLLIFVSGKIVLTGAKVRDETYTAFENIYPVLTEFRKNQQWYGSGSFSIAIGYTCCNPWARNIMNQYHCLYYFFFFVQLSEYNCVRCRAEVFLIEMTKFFTQFLFWVIYLYKF

SEQ ID NO: 15665 - protein, 157 aa, Triticum aestivum
  unsure (1)..(157): unsure at all Xaa locations
MAPTVMASSATSVAPFQGLKSTAGLPVSRRSNGASLGSVSNGGRIRCMQVWPIEGIKKFETXSYLPPLNXGGXLSKQVDYLIAPSWVPCLXFNKVGFIFREHNASPGXYYDGRYXTMLKLPKFGAPTPKNDXQGGGVKKGYPDPMSDNFTWPSSSSP

SEQ ID NO: 15666 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYESSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 15667 - protein, 337 aa, Zea mays
MAKIKIGINGFGRIGRLVARVALQSDDVELVAVNDPFISTDYMTYMFKYDTVHGQWKHSDITVKDSKTLLFGEKPVTVFGIRNPEEIPWGEAGAEYVVESTGVFTDKEKAAAHLKGGAKKVVISAPSKDAPMFVVGVNEEEYKSDVNIVSNASCTTNCLAPLAKVIHDNFGIVEGLMTTVHAITATQKTVDGPSAKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 15668 - protein, 100 aa, Triticum aestivum
  unsure (1)..(100): unsure at all Xaa locations
MSGVATDEDKKLSGDGGGGHIGIKVKGQDGNEVXFFTKRSSQLKKLMTALFGRQFVDIRSIAFLLDGRRLRGEQTPDDLEIGWKSTSIGEHYAPVRTGCN

SEQ ID NO: 15669 - protein, 213 aa, Triticum aestivum
  unsure (1)..(213): unsure at all Xaa locations
ELIANCLKTQGVEVVFGIVGIPVVEVAEACVAAGIRFIGFRNEQSAAYAASVYGYLSGRPGVCLSVGGPGVVHALAGLLNSKINCWPMVLLSGSSETDQVERGAFQELDQVEACKPYCKYAARPTSLEQLPFIVEKAFRTALYGRPGAAYVDLPADFIQYPIRNKQVMEDIQVPKVPNAPKAMADVDDLNKAVSLLXNAKHPLIVVGKGASYA

SEQ ID NO: 15670 - protein, 364 aa, Aspergillus oryzae
MSSYNIVVFGGDHCGPEVTAEAIKVLRAVEKNRDVTFNLQDHLLGGASIDATGSPLTDEALNAAKNADAVLLGAIGGPKWGTGAVRPEQGILKLRKEMGTFGNLRPCNFAAPSLVESSPLRADVCRGVNFNIIRELTGGIYFGERKEDDGSGYAMDTEPYSRAEIERIIRLAAHLALQHDPPLPVWSLDKANVLATSRLWRKVVTEVMAKEFPQLKIEHQLIDSAAMIMVKNPRQLNGIVVTSNLFGDIISDEASVIPGSLGLLPSASLSGIPDGNSKVNGIYEPIHGSAPDIAGKGIVNPVAAILSVAMMMQYSFGLFAEARAIEQAVSNVIESGVRTGDIGGKATTAEVGDAVAAELEKLLK

SEQ ID NO: 15671 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 15672 - protein, 375 aa, Dechloromonas sp. RCB
MASMQGARTGQNKLRDFGFEVGAVLGHHLVSPFHGADCGRQRGATGVLKTFAGLEQRLLADDAKAAHFLYLVVAIGDDPVPGNQLGRYFADILDGDGVGKDVAVVFRVGLLRNELRHGLHFDSVLVGVGHGIISSVIVQGSIMSAKDYVIAPSILSANFAKLGEEVANVIASGADWIHFDVMDNHYVPNLTIGPLVCEAIRPCTTAPIDVHLMVKPVDRIIPDFAKAGANIITFHPEASEHVDRSLSLIRDAGCKGGLVFNPATPLDYMDYVLDKIDVILLMSVNPGFGGQKFIPGTLAKAKQARAKLDAYERETGRRIRLEIDGGVNTANIAEIARAGVDAFVAGSAVYGAGKDSDPHRYDSIIGALRSELAKV

SEQ ID NO: 15673 - protein, 763 aa, ASPERGILLUS NIDULANS FGSC A4
MAVFKSWNLALLSSLFIPALCQSNYPDCTTGPLSELPICDTSLSPLERAKSLVSALTLEEKINNTGHEAAGSSRLGLPAYNWWNEALHGVAEKHGVSFEESGDFSYATSFPAPIVLGAAFNDALIRRVAEIISTEARAFSNSDHAGIDYWTPNVNPFKDPRWGRGQETPGEDPLHCSRYVKEFVGGLQGDDPEKPKVVATCKHLAAYDLEEWGGVSRFEFDAKVSAVDLLEYYLPPFKTCAVDASVGAFMCSYNALNGVPACADRYLLQTVLREHWGWEGPGHWVTGDCGAVERIQTYHHYVESGPEAAAAALNAGVDLDCGTWLPSYLGEAERQGLISNETLDAALTRLYTSLVQLGYFDPAEGQPLRSLGWDDVATSEAEELAKTVAIQGTVLLKNIDWTLPLKANGTLALIGPFINFTTELQSNYAGPAKHIPTMIEAAERLGYNVLTAPGTEVNSTSTDGFDDALAIAAEADALIFFGGIDNTVEEESLDRTRIDWPGNQEELILELAELGRPLTVVQFGGGQVDDSALLASAGVGAIVWAGYPSQAGGAGVFDVLTGKAAPAGRLPITQYPKSYVDEVPMTDMNLQPGTDNPGRTYRWYEDAVLPFGFGLHYTTFNVSWAKKAFGPYDAATLARGKNPSSNIVDTFSLAVTNTGDVASDYVALVFASAPELGAQPAPIKTLVGYSRASLIKPGETRKVDVEVTVAPLTRATEDGRVVLYPGEYTLLVDVNDEYPTAKFEIKGDVQVLEKFPLSGNDSD

SEQ ID NO: 15674 - protein, 577 aa, GIBBERELLA ZEAE PH-1
MAVEKVTSDAPVVGEKSVVRDVDERAPEAFTATGEEYEQEDFMTRTGLNAKSFTRKHYGLGLVELDRKMKPRHLQMVAIGGSIGAGFFVGSGSALSKGGPATLFIDFFLVGVMVFNVVYAMGELAVMYPISGGFYTYAARFIDPAFGFAMAWNYCLQWAATLPLELTVCAITIQYWAPDSNPGIWIAVFLIAIIILNMFGTMGYAEEEFWAACFKLTSISIFMIIALVLVCGGGPSSGSYSTYQGFKLWEDPGAFKNGFKGFCSVFVTAAFSFAGSELVGLAAAESRNPTESVPKAIKQVFWRICLFYIVALLFVGMLVSCNDENLLSSSSYSNSAASPFVLVGKYSGLKGLDHYMNAVILSSVLSLGIASVYGGSRTLLALAQQGFAPKIFTWVDRAGRPLPSVGFIIAFGCLAFLNLDAAGPVIFDWLLALSGLAMLVCWGSICLAHIRFRAAWKYNGHTLDEIPFKAIGGVYGSWVGLIFVVVILIAQFYVAIVAPVGESGMGTVEDFFMQYLGLPIVLAFWAGGVIWKRTSWISIDKIDIDTGRREHDWDSINAWRAELATFPWWKRLMYTLF

SEQ ID NO: 15675 - protein, 125 aa, Salmonella enterica
MPKPMFGDNGSGMHCHMSLSKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLD

SEQ ID NO: 15676 - protein, 241 aa, Brassica oleracea var. botrytis
MGRGRVQLKRIENKINRQVTFSKRRSGLLKKAHEISVLCDAEVALVIFSSKGKLFEYSTDSCMERILERYDRYLYSDKQLVGREISQSENWVLEHAKLKARVEVLEKNKRNFMGEDLDSLSLKELQSLEHQLHAAIKSIRSRKNQAMFESISALQKKDKALQDHNNALLKKIKEREKNTVQQGGQLIQCSNNASILQPQYCLTSSRDGFVGRVGEENGVASLLAEPNSLLPAWMLRPTTKE

SEQ ID NO: 15677 - protein, 508 aa, Rhodospirillum rubrum
MGVLDPNRRKGLTMPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 15678 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 15679 - protein, 247 aa, Zea mays
MLAEDELFRDRDDREGHRRRAPGAAPRFPNRASYYVPSQDRAIPRRLAVAREENTKLRDTRFPSHSPQPSDIIFDVVAPRRDDRFSAAAPELKLRPILTRRPPPRPDAAGDGGSNAAASPTGRARPPRFRLHAAKGGPPLPPPDQHRRNKAEGGCTRRLRRGSRLQWVYESLVVVKESADPEEDFLESMAEMVAANGVRSPRGLEELLACYLALNAADHHRAIVVAFRRAWLHLHLHLRRVPPPPSL

SEQ ID NO: 15680 - protein, 385 aa, Eremothecium gossypii
MRKRNGAAAPRNGSVYNGGCGQLLCRTQLQPVATMSSPSIPKTQHAIVFDKNGGPLEYREIEVPEPKPTELLINVKYSGVCHTDLHAWKGDWPLPTKLPLVGGHEGAGVVVAMGENVRGWQVGDLAGIKWLNGSCMSCEACEQGHESNCPEADLSGYTHDGSFQQYATADAVQAAHIPAGTDLAQVAPILCAGITVYKALKSANLRAGNWVAISGACGGLGSLAIQYARAMGYRVLEIDGGDEKEALFRKLGGEVFVDFRKSKDVVADVVKATGGGAHGVINVSVSEAAIESSTEYVRSNGTVVLVGLPGGAKCKSDVFNHVVKSVSIVGSYVGNRADTREALDFFARGLVQCPIKVVGLSELPDIYGKMERGEVAGRYVVDTSK

SEQ ID NO: 15681 - protein, 974 aa, Solanum tuberosum
MATFAVSGLNSISSISSFNNNFRSKNSNILLSRRRILLFSFRRRRRSFSVSSVASDQKQKTKDSSSDEGFTLDVFQPDSTSVLSSIKYHAEFTPSFSPEKFELPKAYYATAESVRDTLIINWNATYEFYEKMNVKQAYYLSMEFLQGRALLNAIGNLGLTGPYADALTKLGYSLEDVARQEPDAALGNGGLGRLASCFLDSMATLNYPAWGYGLRYQYGLFKQLITKDGQEEVAENWLEMGNPWEIVRNDISYPVKFYGKVIEGADGRKEWAGGEDITAVAYDVPIPGYKTKTTINLRLWTTKLAAEAFDLYAFNNGDHAKAYEAQKKAEKICYVLYPGDESLEGKTLRLKQQYTLCSASLQDIIARFEKRSGNAVNWDQFPEKVAVQMNDTHPTLCIPELLRILMDVKGLSWKQAWEITQRTVAYTNHTVLPEALEKWSFTLLGELLPRHVEIIAMIDEELLHTILAEYGTEDLDLLQEKLNQMRILDNVEIPSSVLELLIKAEESAADVEKAADEEQEEEGKDDSKDEETEAVKAETTNEEEETEVKKVEVEDSQAKIKRIFGPHPNKPQVVHMANLCVVSGHAVNGVAEIHSEIVKDEVFNEFYKLWPEKFQNKTNGVTPRRWLSFCNPELSEIITKWTGSDDWLVNTEKLAELRKFADNEELQSEWRKAKGNNKMKIVSLIKEKTGYVVSPDAMFDVQIKRIHEYKRQLLNIFGIVYRYKKMKEMSPEERKEKFVPRVCIFGGKAFATYVQAKRIVKFITDVGETVNHDPEIGDLLKVVFVPDYNVSVAEVLIPGSELSQHISTAGMEASGTSNMKFSMNGCLLIGTLDGANVEIREEVGEDNFFLFGAQAHEIAGLRKERAEGKFVPDPRFEEVKAFIRTGVFGTYNYEELMGSLEGNEGYGRADYFLVGKDFPDYIECQDKVDEAYRDQKKWTKMSILNTAGSFKFSSDRTIHQYARDIWRIEPVELP

SEQ ID NO: 15682 - protein, 296 aa, Pinus pinea
SAKGFFEVTHDISHLTCADFLRAAGVQTPLIVRFSTVIHERGSPETLRDPRGFAVKFYTREGNFDLVGNNFPVFFVRDGMKFPDMVHALKPNPKSHIQEDWRILDFFSHHPESLHMFTFLFDDLGIPLNYRHMDGSGVHTFTLVNKAGRQTYVKFHWRPTCGVKCLLDDEAVVVGGTNHSHATKDLYDSIAAGNYPEWKLFIQTMDPRDEDKYDFDPLDVTKTWPEDIFPLQPVGRMVLNKNIDNFFAENEQLAFCPALVVPGVYYTEDKLLQTRVFSFADTQRHRLGPNYLMLPA

SEQ ID NO: 15683 - protein, 339 aa, Zea mays
  unsure (1)..(339): unsure at all Xaa locations
MGKINIGXNGFRRIGRLVARVALQSEDVXLVSDNDPFITTDYMTYMFKYDTVHGHCEHSNITLKDSKTLSLADXQVRSPCFGIMNPDEIPWGEAGVXYVVESTGVFTDKDKAAAHLKGGAKNDDISAPSKHAPMLVVGANEDKYTLDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 15684 - protein, 89 aa, Zea mays
DLGILVQWSDIDHVNLILTLGGTGFTPRDVTPEATKMVIQKEAPGLTFVMLQESLKITPFAMLSRATAGIRGSTLVRTNTPTRKIDNFL

SEQ ID NO: 15685 - protein, 110 aa, Zea mays
AVDKAQPNPRLCFLLRAALHLHWLLLVTSKNNKALQMSVQDANMSSDTDMSKVFEDRTFVSSILNSFPGVDPNDPSVKDLLASLHSQKEEEKKEDKSDKTEDEKNCFKLE

SEQ ID NO: 15686 - protein, 205 aa, Phytolacca americana
SVLCDAEVALIVFSTKTKLFEYATHSSMERILERYESYSYAEKQLVATDSESRQQGSWAMEYPRLVSKLEVLQKNMRHYVGEGIESLTLRELQHLEPQLDTALKRIRTRKNQLMHESISQLQKKQKTMQEHNNLLVKLVKEKDKTQATQKENPRELLMLSSNPLPFPSLSIGGAYQEREMGIKQVIHQSEPNTSSAMPHWMLHHL

SEQ ID NO: 15687 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 15688 - protein, 407 aa, Pseudomonas aeruginosa PAO1
MSACACDGGQLRPLDEALAELLARAPRPPACESLALERALGRVLGEDLLAPMDLPHWDNSAMDGYALCSADLPRSGGSLTVGARIAAGDTRGMSLPLGQAARIFTGAPLPTGADCVVPQELCVVDGERVQLPPVSAGQHVRRRGEELRRGAPVLRAGQRLRPQELGLLASLGVATVSVRRRLRIGLLSSGDELREPGQTLLAGQIYNANRYCIGALLRGLGFEVHDEEVLADELVASRDALSLAASEWDALVTSGGVSVGEEDHLKRAIAELGEVNLWRLAIQPGKPFAFGSVAGKPWLGLPGNPAAALVTALLVARPFLLRQQGLFDVVPRPLALPAAFDWPQPRARRQYLRARLDERGRVEIHPQQGSAMLLAASWADGLAVIERGATLGVGDAIDFLPFSALMA

SEQ ID NO: 15689 - protein, 418 aa, Zea mays
  unsure (1)..(418): unsure at all Xaa locations
PRGRPGSCLDPLVRGQASSMLSATTVPLQQGGGLSEFSGLRSSASLPMRRNATSDDFMSAVSFRTHAVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVXDVPLVSVDFRCSDVSSTIDASLTMVMGDDMVKVISWYDNEWGYSQRVVDLADICANQWK

SEQ ID NO: 15690 - protein, 508 aa, Theobroma cacao
MANPKILYPFSVSLLFLISISSAAASSFLDERRLGGSSFPSIHAKKLIRELNLFPKEEVNVVDGGQVSLPEDSRLVEKRFKFPNLAVPGGVSVEDLGHHAGYYKLANSHDARMFYFFFESRNSKKDPVVIWLTGGPGCSSELALFYENGPFTIAENMSLIWNQYGWDMASNLLYVDQPIGTGFSYSSDRRDIRHNEDEVSNDLYDFLQAFFAEHPEFEKNDFYITGESYAGHYIPAFAARVHQGNKAKDGIHINLKGFAIGNGLTDPAIQYKAYTDYALDMGVIKKSDYNRINKLVPVCEMAIKLCGTDGTISCMASYFVCNAIFTGIMALAGDTNYYDIRTKCEGSLCYDFSNMETFLNQESVRDALGVGSIDFVSCSPTVYQAMLVDWMRNLEVGIPALLEDGVKLLVYAGEYDLICNWLGNSRWVHAMEWSGQKEFVASPEVPFVVDGSEAGVLRTHGPLGFLKVHDAGHMVPMDQPKAALEMLKRWTKGTLSEAADSEKLVAEI

SEQ ID NO: 15691 - protein, 96 aa, Zea diploperennis
MRRRACCEKEGVKRGAWTTKEDDALAAYVKAHGEGKWREVPQKAGLRRCGKSCRLRWLNYLRPNIRRGNISYDEEDLIIRLHKLLGNRWSLIAGRL

SEQ ID NO: 15692 - protein, 483 aa, Arabidopsis thaliana
MEDIQEEENGTDEEVLGSSLTMEKVAAAKQYIENHYKAQNKNIQERKERRWILERKLASSGVPKEEQINMIKDLERKETEFMRLKRNKISVDDFELLTIIGRGAFGEVRLCRERKSGNIYAMKKLKKSEMVMRGQVEHVRAERNLLAEVESHYIVKLYYSFQDPEYLYLIMEYLPGGDMMTLLMREDTLREDVARFYIAQSVLAIESIHRYNYIHRDIKPDNLLLDKDGHMKLSDFGLCKPLDCRNLPSIQENRATDDETMSEPMDVDRCFPDTDNKRSWRSPQEQLQHWQMNRRKLAFSTVGTPDYIAPEVLLKKGYGMECDWWSLGAIMYEMLVGYPPFYADDPISTCRKIVHWRNHLKFPEDAKFSSEAKDLICRLLCNVDHRLGTGGGAQQIKDHPWFKDVVWEKLYEMEAAYKPEVNDELDTQNFMKFDEVNSPAPERTRSGLSRKMLLAPKDLSFVGYTYKNFDAVKGLRHSLGKFT

SEQ ID NO: 15693 - protein, 344 aa, Porteresia coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 15694 - protein, 423 aa, Aspergillus oryzae
MADLRGRKIFKVFNQDFIVDERYNVTKELGQGAYGIVCAATNIQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKIPFQRLFPSANPDALDLLDRMLAFDPSSRISVEEALEHPYLHIWHDASDEPTCPTTFDFHFEVVDDVQEMRRMIYEEVVRFRAAVRQQSQAQAAAAAQQQQIAQQTNVPIPENQQGVWKQEEPKPQEALAAGGGVHNDLESSLQRGMDVQ

SEQ ID NO: 15695 - protein, 699 aa, Oryza sativa
MAPPGVGVGVAYLWGKGRGGRKGTPVVVTMESPFYSVVEVDGPDAEAELRAAAVAMDKGGGRGRSRSRTARQLTWVLLLRARRAAGRLASLAAAAARRFRRSPSAEAADELGRGRGRLMYGFIRGFLALSLLALAVELAAYWNGWRLRRPELRVPEAVEIEGWAHSAYMSWMSFRADYIRRPIEFLSKACILLFVIQSMDRLVLCLGRFWIKLRKIKPRIEGDPFREGSGYQHPMVLVQIPMCNEKEVYEQSISAACQLDWPREKFLIQVLDDSSDESIQLLIKAEVSKWSHQGVNIVYRHRVLRTGYKAGNLKSAMSCDYVKDYEFVAIFDADFQPTPDFLKKTIPHFEGNPELGLVQARWSFVNKDENLLTRLQNINLCFHFEVEQQVNGVFLNFFGFNGTAGVWRIQALEESGGWLERTTVEDMDIAVRAHLNGWKFIFLNDVKVLCELPESYEAYRKQQHRWHSGPMHLFWLCLPDILTAKISSWKKANLILLFFLLRKLILPFYSFTLFCVILPLTMFVPEAELPVWVICYVPVCMSFLNILPSPRSFPFIVPYLLFENTMSVTKFNAMVSGLFKLGSSYEWIVTKKSGRSSESDLSTAVERDTKDLTLPRLQKQISESELIDLKMQKERQEKAPLGAKKANKIYKKELALSLLLLTAATRSLLSAQGIHFYFLLFQGVSFLFVGLDLIGEQID

SEQ ID NO: 15696 - protein, 775 aa, Xanthomonas campestris pv. campestris str. ATCC 33913
MRPTQPMSNDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEDVKLATTGMGAAGISCVNMLVSLGLKSENILALDRDGVIHTGRTDLDPDKQRYARDTDKRTLAEIVEGADIFLGLSAAGILKPEMVATMARQPVIFALANPNPEITPEAAKAVRPDCIIGTGRSDYPNQINNVLCFPYLFRGALDVGATGINEDMKIACVKAIAAMARREASDLGAAYGGETPSFGPEYLIPRPLDPRLLVELSSAVAQAAMDSGVATRPIADMAAYRDRLSQFVYRTSLMMKPVYDRARADKQRVVYAEGEEEVVLRAVQNVIDEGLALPILIGRPDVIEARIQRMGLRIRAGEDFEITNIHDDPRFNDYWQYYYALTERRGVTVTAAKELMRSRPTLIAAVMVARGEADAMLSGVVGRFHKKLGYARSVIPLEPRVSSTSAMTGVINQQGMFFFLDTHVQEDPTVEQVVEATLQAAYRLKLFGIEPNIALLSHSNFGSHDSRDALKMREVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKQRDAEKHNAEKNGG

SEQ ID NO: 15697 - protein, 451 aa, Zea mays
  unsure (1)..(451): unsure at all Xaa locations
MATHAALAASRIPAGARLHSRAAASSRHGGQRVDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPXGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKXAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 15698 - protein, 422 aa, Streptomyces coelicolor A3(2)
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 15699 - protein, 144 aa, Triticum aestivum
  unsure (1)..(144): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLXVQQVGFIFREHNASPGYYEGRYWXMWKLPKFGVTDAXQVINKVEEARRIPDRFR

SEQ ID NO: 15700 - protein, 358 aa, Arabidopsis thaliana
MAGIRLLPEEPETTPQQQARAAAAVTTTTTDSLASDDDRSIAADSWSIKSEYGSTLDDDQRHADAAEALSSANFRVSSDYSSDKEESGADGGGQSMLGLQSYWDAAYSDELTNFREHGHAGEVWFGDDVMEIVTSWTKDLCVEISQRNMSVSENDVTTEVNDQADKYLSSWNVLDLGTGNGLLLHQLAKEGFSDLTGTDYSDGAVELAQHLSQRDGFPNIRFMVDDILDTKLEQQFKLVMDKGTLDAIGLHPDGPVKRVMYWDSVSKLVAPGGILVITSCNHTKDELVEEVENFNIRKSNLCRGDGNDANNVLSSGSEAASRIDQPPFEYLSHVRTYPTFMFGGSVGSRVATVAFLRK

SEQ ID NO: 15701 - protein, 615 aa, Saccharomyces cerevisiae
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFHTSKINAISWKPAEKGANEEEIEEDLVATGSLDTNIFIYSVKRPMKIIKALNAHKDGVNNLLWETPSTLVSSGADACIKRWNVVLE

SEQ ID NO: 15702 - protein, 777 aa, Phragmites australis
MSLEVEKPGGTESTNRLSLKRYDSLFGDAEKVSGAKHHGSEVSWSRTLHLAFQSVGIIYGDIGTSPLYVYSSTFPSGIKNNDDLLGVLSLIIYTLIIIPMLKYVFIVLYANDNGDGGTFALYSLISRYAKIRLIPNQQAEDAMVSNYSIEAPSSQLRRAQWVKQKIESSKAAKIALFTLTILGTAMVMGDGTLTPAISVLSAVSGIREKAPSLSQTQVVWISVAILFMLFSVQRFGTDKVGYTFAPVISVWFLLIAGIGLYNLVVHDIGVLRAFNPMYIVHYFKRNGKDGWVSLGGVILCVTGTEGMFADLGHFNVRAVQISFTGILFPSVALCYIGQAAYLRKFPENVGDTFYRSIPAPLFWPTFIVAICAAIIASQAMLSGAFAILSKALSLGCLPRVRVIHTSKKYEGQVYIPEVNFMMGLASTIVTIAFRTTTSIGNAYGICVVTTFSVTTHLMTLVMLLIWKKHIVFILLFYVVFGFTELIYLSSILSKFIEGGYLPFCFAVVLMTLMATWHYVHVKRYWYELDHVVPTNEMTTLLEKNDVRRIPGVGLLYTELIQGIPPVFPRLIKKIPSVHSIFVFMSIKHLPIPHVVPAERFLFRQVGPREQRMFRCVARYGYSDRLEESKEFAGFLADRLKMFIQEESAFAQNEAENDESSPSTEVPEAQTRPRRSTHSVVHSEEAIQPRVSSHSGRITFLANYSVEEEKQLIDREVERGVVYLMGEANVSAGPKSSILKKIVVNYIYTFLRKNLNEGHNALSIPKDQLLKVGITYEI

SEQ ID NO: 15703 - protein, 409 aa, Triticum aestivum
MAAATTTASRPLLLSRQQAAASSLQCRLPRRPGSSLFAGQGQASTPNVRCMAVVDTPSAPAVAPARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTEVHQRVPLYVGSVEEVEKVEKFLSSE

SEQ ID NO: 15704 - protein, 146 aa, Arabidopsis thaliana
MQWQDVTVKMVVDAPASVAYKLYADREMFPKWMPFLSSVEAMEGSPDLSRYLVKLESFGQNIEYHFLAKNLQPIPDRKIHWRSIEGFENRGSVRFFPRGPSSCLVEISFSYEVPNAFAPVAFAMKPFMEKIIRGGLERFAAFVKTI

SEQ ID NO: 15705 - protein, 355 aa, Glycine max
  unsure (1)..(355): unsure at all Xaa locations
MEWHRGHTIGQGSSATVSTATCRGGVFAVKSTELPQSEPLKKEQKILSSLSSPYVVAYKGCDITMENNKLLFNLFMEYMPFGTLAQAATRRCAGRLLEESVIARYTRQIVQGLDYLHSKGLVHCDIKGANILIGEDGAKIGDLGCAKSAADSTAAIGGTPMFLAPEVARGEEQGCATDIWSLGCTVIEMVTRWCTMGLMWEDPFFXLYHIAYSSEVPEIPCFLSKEAKDFLGKCLRRNPQERWKASELLKHPFIEKLCFNKEVLESNTSSPTSVLEQGYWSCVEESESLGDLIHKTRKFETLAAGRVRMLALSSGVPYWARHDDENWITARGNGVEGFANCGAETASSASHGLSH

SEQ ID NO: 15706 - protein, 84 aa, Zea mays
MKVKILQWHAVASWTWDAQDETCGICRMAFDGCCPDCKFPGDDCPLIWGVCNHAYHLHCILKWVNSQTSTPLCPMCRREWQFKG

SEQ ID NO: 15707 - protein, 237 aa, Pinus taeda
MGSLESEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKKCGILGLGGVGHMGVKIAKAFGLHVTVISSSDKKKEEAMEVLGADAYLVSKDTEK

SEQ ID NO: 15708 - protein, 300 aa, Salmonella typhimurium LT2
MMSRKDGFLALLVVVVWGLNFVVIKVGLHHMPPLLLAGLRFLLVAFPAIFFVARPKVPLTLLLGYGLTISFGQFAFLFCAIKFGMPAGLASLVLQAQAFFTMALGAFVFSERLQRKQLAGIALAIIGVLVLIEASLNGQHIAMSGFMLTLAAAFSWACGNIFNKKIMQHSPRPAVMSLVVWSALIPILPFLLSSLLLEGADHITQSLITIDMTTILSLLYLAFVATILGYGIWGALLGRYETWRVAPLSLLVPVVGLASAAVLLGETLTGMQLAGAVLIMAGLYINVFGFRVRRTARVSG

SEQ ID NO: 15709 - protein, 318 aa, Chlamydia muridarum
MMLVLRFANLYVEPMAIFLIFLNAFIWSSSFALSKSAMDAASPLFVTGSRMVLAGIVLFGLLLFKRESFRLPRQAVMPIVLLSVIGFYLTNVLEFIGLQGLSSSKACFIYGFSPFTAAFCSYVQLREVVTWKKLGGLSLGLVSYLVYLLFGGGEDVSEWGWQLGMPELLLIVATCLSSYGWTLLRKLERQCESLSITAINAYAMVIAGILSLAHSAITEVWNPLPVENPVLFLQSIGALVIFSNLICYNLFAKLLRSFSSTFLSFCNLVMPLFASFFGWLLLGESFPPGLLFAVGFMVLGCRLIYHEEFRQGYVLSSE

SEQ ID NO: 15710 - protein, 428 aa, Zymomonas mobilis [sequence omitted]

SEQ ID NO: 15711 - protein, 469 aa, Bacillus subtilis subsp. subtilis str. 168
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 15712 - protein, 159 aa, Yersinia mollaretii
SDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEV

SEQ ID NO: 15713 - protein, 193 aa, Zea mays
  unsure (1)..(193): unsure at all Xaa locations
MDPTQFRPSRMHDTTLTTTNVAAIASEPYEELTAGAPAPILLEDYHLIEKVAHFARERIPERVVHARGASAKGFFXCTHDVTSLTCADFLRASGVRTPVIARFSTVIHERWSPETIRDPCGFAVKFYTREGNWDLLGNNFPVFFIRDGIKFPDVIHAFXPNPRSHVQEYWCVFDFLSHLPESLHTXFFFLFDH

SEQ ID NO: 15714 - protein, 350 aa, Pseudomonas putida KT2440
MYTAIGYAAQTPTSPLAPMTFQRRSPRPDDVAIDILYCGVCHSDIHQARNEWGIAVYPLMPGHEIIGRVTAVGDKVTAHKVGDLVGVGCMVDSCRTCEACAKDLEQYCLEGPTMTYATPDRVDGSNTMGGYSSSIVVSEHFVVRIPAGMDLPSAAPILCAGITTYSPLKHHGVGPGHKIGILGMGGLGHMGIKLAKALGAEVTLFTRSQAKAEEARRQGADHVIVSTDAEQMRAAAGRFDFLLDTIPVQHDLNPYLETLKFDGVHILVGLIEPIDPALHAANLVMKRRVLAGSLIGGIAETQEVLDFCAEHDIRCDIEMLDIRNINQAYERMIAGDVKYRFVIDMATLQG

SEQ ID NO: 15715 - protein, 284 aa, Gluconacetobacter xylinus
MIKPLKKAVLPVAGLGTRFLPATKCVPKEMLTVVDRPLIQYAIDEAREAGIEEFCLVSSRGKDSLIDYFDISYELEDTLKARKKTSALKALEATRVIPGTMLSVPPAGTAGPWHAIWCAREFIGNDPFAILLPDDVVQSKKSCIGQLVEVYNKTGGNVLAVTEVPREQTGSYGILDVGKDDGKTVEVKGLVEKPDPKDAPSTLSVIGRYVLTADVLKHLAKLEKGAGGEVQLTDAMAKTIGHVPFHGYRYEGKRFDCGSKIASWKPRSPLRWSVRNWLPACVNS

SEQ ID NO: 15716 - protein, 500 aa, Pseudonocardia sp. K1
MTVIAKPDHLLRDDVQKFIDRPKKLFINGQWHDSIKGETLEVYDPAVGTKICTVAAGDAEDVDRAVAAARHAFDEGPWSKLNPSERGRLVWRLADLLEEHADEFAQIDALDNGKPVTDARAVDVAFSIELLRYMAGWSNKIYGETIPLTNPADFHAYTLREPVGVVGQIVPWNFPLMMAVWKVAPALAAGCTVILKPAEQTPLSALRLAELTEEAGFPPGVFNVITGFGETAGAAIAAHDNIDKVAFTGSTEVGRLIAQAASGNLKKVSLELGGKSPVIVFGDSDIEQAVAGASSAIFYNNGQTCTAGSRLYVHRKVYDKVVEGIASEASALPIGHGLDPATRIGPLISAEQRDRVTGYIAQGREAGAEVIVGGDTVGDGGYFIQPTILTKTDPSMSVVREEIFGPVLCAMAFDEDTIDSVVREANNSVYGLAASIYTRDISVAHRVAKRLKAGTIGINTHHVVDVALPFGGFKQSGYGRDMGRDAIDQYTEVKSIGIAL

SEQ ID NO: 15717 - protein, 314 aa, Arabidopsis thaliana
MERYKCRFCFKSFINGRALGGHMRSHMLTLSAERCVITGEAEEEVEERPSQLCDDDDDTESDASSSSGEFDNQKMNRLDDELEFDFAEDDDVESETESSRINPTRRRSKRTRKLGSFDFDFEKLTTSQPSELVAEPEHHSSASDTTTEEDLAFCLIMLSRDKWKQQKKKKQRVEEDETDHDSEDYKSSKSRGRFKCETCGKVFKSYQALGGHRASHKKNKACMTKTEQVETEYVLGVKEKKVHECPICFRVFTSGQALGGHKRSHGSNIGAGRGLSVSQIVQIEEEVSVKQRMIDLNLPAPNEEDETSLVFDEW

SEQ ID NO: 15718 - protein, 186 aa, Zea mays
MAPSAALAPVAFRSAFSTPLASKPTRNRMNIEGAFCLPCSTRKRASYRPFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 15719 - protein, 315 aa, Podospora anserina
MAQPNVVPEEDYDYEALPPNFSLLQNMAAGAFAGIAEHCAMYPIDAVKTRMQIVNPSAGSVYSGVFQSTYKMASTEGILSLWRGMSSVIVGAGPAHAVYFATYEAVKHVMGGNQAGVHHPLAAATSGACATIASDALMNPFDVIKQRMQIAESAKLYRSMTDCAKYVYKNEGIKAFYVSYPTTLSMTVPFTALQFLAYESISTSMNPTKAYDPFTHCVAGAVAGGFAAALTTPMDVIKTMLQTRGSAHDAELRTVNGFMAGCRLLFKREGAKGFFKGVQPRVLTTMPSTAICWSAYEASKAYFIRQNDSASESST

SEQ ID NO: 15720 - protein, 361 aa, Synechocystis sp. WH 8501
MTRQYRITLLPGDGIGPEILAVTVDILKVVGKQLEIDFQFQEALIGGVAIDETGKPLPEATLKMCRSSDAVLLAAIGGYKWDNLPREKRPETGLLAIRAGLNLFANLRPATILPQLINASSLKPEIVQGVDIMVVRELTGGIYFGKPKGIFETETKEKRGVNTMAYTESEVDRIAKVAFETAQKRGGKLCSVDKANVLDVSQLWRDRVTLMAEKYPDVELSHLYVDNAAMQLVREPKQFDTIITGNLFGDILSDAAAMLTGSIGMLPSASLGLEKPGLFEPVHGSAPDIAGEDKANPLAQVLSAAMMLRYGLNEPKAATKLEKAVLEALAQGYRTGDIMSDGMKAVGCKGMGEVLLRILES

SEQ ID NO: 15721 - protein, 131 aa, Triticum aestivum
TFPQYSMSVTSAPAPPPANNDEGADGCAEAEASGSKPSAVADVEVTMVESHANLRMLSRRRPRQLLRLLVGLQGHRLTVLHLNMSSASHMVLYSLSLKVEDDCQLTSVDEIATAAHQIIEKIQEEQDFTSA

SEQ ID NO: 15722 - protein, 673 aa, Glycine max
  unsure (1)..(673): unsure at all Xaa locations
ICALADRCDQKGLSVNERLGRIAETLEKMMESCTQKDTQQMVGSPDVAKVSNSSMTEESDVPSPKLSDWSRRGSEDMLDCFPEADNSVFMDDLKGLPLMSCKTRFGPKSDQGMTTSSAGSMTPRSPLMTPRTSQIDLLLAGKGAYSEHDDLPQMNELADIARCVANAPLDDDRTTSYLLSCLDDLRVVVDRRKFDALTVETFGTRIEKLIREKYLQLTEMVDVEKIDTESTVDDDLLEDDVVRSLRTSPIHSSRDRTSIDDFEIIKPISRGAFGRVFLAKKRTTGDLFAIKVLKKADMIRKNAVESILAERDILITVRXPFVVRFFYSFTCRENLYLVMEYLNGGDLYSLLRNLGCLDEEVARVYIAEVVLALEYLHSLHVVHRDLKPDNLLIAHDGHIKLTDFGLSKVGLINSTDDLSGPAVNGTSLLEEDETDVFTSEDQRERRKKRSAVGTPDYLAPEILLGTGHGFTADWWSVGVILFELLVGIPPFNAEHPQTIFDNILNRKIPWPAVPEEMSPQAQDLIDRLLTEDPNQRLGSKGASEVKQHVFFKDINWDTLARQKAAFVPASESALDTSYFTSRYSWNTSDGLVYPASDDEDSSDADSLSGSSSCLSNRQDEVGDECWGLTEFDSGTSVNYSFSNFSFKNLSQLASINYDLTKGWKDDPPTNSSA

SEQ ID NO: 15723 - protein, 195 aa, Leptospira interrogans serovar lai str. 56601
MEIMFLLIDNYDSFTYNLYQYFSQIGNEIEVYRNDKITLDEIKHLSPKAIILSPGPGRPEDSKVCLDVIRELGGKLPILGVCLGHQAIGLVHGGKIVSAPSIMHGKISLVEHDGKDIYKGISSPFVATRYHSLVIQPESLPKELEIASKTPDGVIMGVRHKTKKHLYGVQFHPESIMTGAGLDLIRNFSSIVQEL

SEQ ID NO: 15724 - protein, 485 aa, Grateloupia dichotoma
NSVERTRIKNERYESGVIPYAKMGYWDPDYVIKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAASGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVMARNEGREYVAEGPQILQDAAKTCGPLQTALDLWKDITFNYTSTDTADFVETPTANV

SEQ ID NO: 15725 - protein, 305 aa, Prochlorococcus marinus
RIGRNFMRCWLSRGENTGLDLVGVNVTSDPKTNAHLLKYDSILGQIKDAEIDYTDDTFVINGKTIKCFSDRNPMNLPWREWGIDLVIESTGVFNTFEGASKHLQVGAKKVILTAPGKGEGVGTFVVGVNADQYRHDDFNVLSNASCTTNCLAPIVKVLDQSFGINKGLMTTIHSYTGDQRILDNSHRDLRRARAAAMNIVPTSTGAAKAVALVYPEMKGKLTGIAMGVPTPNVSAVDLVFESGRSITADSINAAPKSASEGSMKGIIKYGDTPLVSSDYAGTNDSTIVDTALTMTIGDNLGKVVA

SEQ ID NO: 15726 - protein, 359 aa, Escherichia coli O157:H7
MSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 15727 - protein, 235 aa, Malus x domestica
MGRGKVELKRIENKINRQVTFAKRRNGLLKKAYELSVLCDAEVALIVFSTSGKLYEFCSGPSIAKTLERHQRCTYGELGASQSAEDEQSRYQEYLKLKTKVEALQRTQRHLLGEDLVHLGTKELQQLENQLDVSMKKIRSTKTQFMHVQISELQRKEEMLLEANTGLRRKLEEITAGHQRSWNGNHQAAQLEGFPEHLQYNNALQIGTPVVTNDEANVATSSAQNGTGFFPGWML

SEQ ID NO: 15728 - protein, 340 aa, Zea mays
  unsure (1)..(340): unsure at all Xaa locations
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTSCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGXIMGYVEEDLVSTDFTGDSRSSIFDAKXAGIALNDHFIKLVSWYDNEWGYSNRXVVDLIRHMFKTQ

SEQ ID NO: 15729 - protein, 425 aa, Glycine max; identical to SEQ ID NO: 6615

SEQ ID NO: 15730 - protein, 418 aa, Glycine max
MAASSLLRSALLAPSSCDRPKVYTNASSSNLKSKGLHSSIFGTSIQCDSLVLQNCNGRGIQPIKATATEIPLPTQQSRSTGKTRVGINGFGRIGRLVLRVATFRDDVDVVAINDPFIDAKYMAYMFKYDSTHGPFKGSINILDDSTLEINGKHVKVVSKRDPAEIPWSDFGADYVIESSGVFTTVEKASSHLKAGAKKVVISAPSADAPMFVVGVNEKTYNPKMDIVSNASCTTNCLAPLAKVVNEEFGIVEGLMTTVHATTATQKTVDGPSMKDWRGGRGAAQNIIPSSTGAAKAVGKVLPELNGKLTGMAFRVPTPNVSVVDLTCRLKKNASYEDVKAAIKYASEGPLKGILGYTDEDVVSNDFVGDSRSSIFDAKAGIALSASFVKLVSWYDNEWGYSNRVLDLIEHMALVGAQN

SEQ ID NO: 15731 - protein, 493 aa, Pseudomonas syringae pv. tomato str. DC3000
MSASDGTPFLQRAIDAECIFNGNWIPSSSALLPVIEPATSELLMNTAMAGAADIAIACREAALAQPAWAAMGPREKAEIFLMAADHAVCAFDELALYVARETGGSLHKGQHEVNETIVLLRQAAGMLSQAHGHGVILPSAAGRLSYARRVAHGVVGVISPFNFPLVLSLRSVAPALAAGNAVVLKPDPQTPISGGFLIARLFEEAGLPKGLLHVLPGAADAGEALCRDTNVQMITFTGSTGAGRKVAEAAGRNLKKVSLELGGKNPLVILEDADLDLAASNAAFGAWLHQGQICMATGLILVHESIVAAFTRKLADKARALTVGNAARGQAALGPLINQRQLQHVHQVVSDSLQAGAQLETGGEYEGLFYRPTVLSGVKPGMRAFEEEIFGPVAVVVSFSSDEQAIELANRSEYGLAAAVISPDVGRATALGDRLRCGMLHINDQTVADECINSFGGRGASGNGSSAGSPSDWDEYSQWQWVTVKNQAPVYPF

SEQ ID NO: 15732 - protein, 417 aa, Cytophaga hutchinsonii
MNEITELAAQQAELTHAVDTVWVAICAALIFQMEGGFALLESGFVRSKNAISIIAKVMIDIMFGGIAFYAVGFGIAYGASNGWWAFGFGIPEGDMGLGLTVSNKLFWFIQMGFAIAAISIVSGAVAERIKIWAYAFFVLFFCACMYPLAANWVWNPNGWLAQLGFNDFAGSAAVHAMGGFAGLAAAIVLGPRIGKYNADGSINPIPGHNLTLSAVGAFILWFGWFGFNPGSTLGAVGKWELIGSVATNTFLSSAMGGISTMVYTFLRYKRIDITMVINGVLAGLVAITAGCNVVSANSAIIIGLIAGILIDVAVVAIDKMKVDDPVGAVAVHGVNGFFGTVAVGLFATKGGLFTTGDAHLLGVQTLGVTVIAVCSFAVTYLVFIVLKKTTGIRLGEREELAGTDAVEFGIEAYTTIE

SEQ ID NO: 15733 - protein, 490 aa, Trichodesmium erythraeum IMS101
MVTATKPEQKVKIGPTKLLINNEWVESASGKRFETINPATGEVICNVAEADAPDVDKAVIAARKAFTSGEWPKISAAKRGELLYKLADLIEKNIEELARLETLDNGKPFKDSLNTDLPLAIACYRYYAGWADKVQGKTIPISGPYFCYTRHEPVGVVGQIIPWNFPLLMQAWKLAPALAMGNTLVMKTAEQTPLSALRVGELVIEAGFPPGVVNILSGYGPTAGAAISHHKDIDKVAFTGSTEVGRLIMEAAAKSNLKRVTLELGGKSPNIVFADADMDAAIEGSHFALFFNQGQCCCAGSRLFVEEKCYDEFVNKSVERAKLRMVGDPFTERVEQGPQVDEEQFNKVMSYIESGQQDGAQMLCGGSRVGDRGYFIAPTVFADVQDNMKIAQEEIFGPVMSIIKFKDIDELVERANNSMYGLAAGVWTQDVTKAHTLAHRLRAGTVWVNCYDVFDAAAPFGGFKQSGLGRELGEYGLQQYTEIKTVTMKM

SEQ ID NO: 15734 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKAWEALAELADACGYPVAVMPSAKGLVPVHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKALLEWGSRVSAANSRPPNPQ

SEQ ID NO: 15735 - protein, 435 aa, Ferroplasma acidarmanus
MIMKDSERTEYFDKTAIEISKKYRGKIRTLSKVPITGMGDFSSLYTPGIAAVSKKIQADKELVYELTGKWNSVAILTDGTRVLGIGNVGPEASIPVMEGKALLFNYLGGVNAIPIPLVVNNNEEFITAAKAIQPYFGGYNLEDIQSPRCFFLLESLQKSMDIPVWHDDQLGTASIILAGVINALRILNKKKEEVKIVFNGAGAANIAAIYLFGAAGFDKGNIIAIDSKGIIEPDRQDIDALMFKNPWKYKIALETNKERIKGDPANAFKGADVVISASVSIPGTIKDEWIRSMNRDPVIFALANPLPEIWPGDAKKAGARIVATGRSDFPNQINNSMVFPGVFRGVLDARAKGVNFGIMVAASYAIADFIKEPTEDHIVPSMEDFDLFPRVASIVARKCVESGLARKSDSTEGFYREASEIINNNRKVYNKLFDL

SEQ ID NO: 15736 - protein, 222 aa, Bacillus cereus ATCC 14579
MRFFIDTANLEDIKKAYKLGVLAGVTTNPSLVAKEGVKFEDRIAEICQAVPKVESVSAEVTPDAVTAEEMIAQAEELIKINGGDKNVTIKLPMTLAGLEACRYLTEKGVKTNVTLIFTVNQALLAARAGATYVSPFLGRLDDISEDGVLLVAKIAELFDVHQLDTQIIAASVRHPDHVTRVAMAGAHIATIPYKVIEQLAMHPLTDQGIEKFAADWAKAPKL

SEQ ID NO: 15737 - protein, 166 aa, Pseudomonas aeruginosa UCBPP-PA14
MLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 15738 - protein, 492 aa, Acacia ampliceps
MDPYKYRPSSTFNTPFWTTNSGTPVYNNDSALTIGSRGPILLEDYHLVEKIANFTRERTPERVVHARGASAKGFFEVTHDITHLTCADFLRGPGVQTPVIVRFSTVIHERGSPETIRDPRGFAVKFYTREGNFDLVGNNFPVFFIRDGMKFPDVIHAFKPNPKSHIQEYWRVLDFCSYLPESLHTFMFLFDDVGVPQDYRHMEGSSVNTYTLINKAGKVHYVKFHWKPTLGVKCLLEEEAIRVGGANHSHATQDLYDSIAAGNYPEWKLYIQTIDPDFEDRFDFDPLDGTKTWPEDLVPLQPVGRLVLNRNIDNFFAENEQLAFSPSLVVPGIYFSDDKVLQARIFAYGDTQRHRIGPNYLQLPVNAPKCAHHNNHYDGTMNFMHRDEEVDYFPSRYDTARHAEKFPIPPVNLIGRRDRRIIEKENNFKQPGDLYRTWAPDRQERFIRRWIGVLSDPKVTHEVRSIWISYLSQADRSLGQKVASHLNMRPSI

SEQ ID NO: 15739 - protein, 145 aa, Zea mays
MINSKMLVQLAKKWQHMAALGRRRLTMTTTIKDGNLYCTSAIANKGHCIVYTADGKRFEVPLAYLSTNVFVELLRMSEDEFGFTSEDRITVPCDAEVMEYVMCLLRRKPSEEVERAVLNSVVMPCNCMSTMTMVSKGLNQSLSIF

SEQ ID NO: 15740 - protein, 366 aa, Neurospora crassa
MRCPIPEHKQNLTFSLPLGDDVLKLFQYAREKQFAIPACNVTSSSTAVAALEAARDQKAPSSLQTSQGCAAFFAGKGIKDSAEKARDSVAGAIAAAHYIRSIAPIYGIPVVRIHTDHCAKKLLFGDGIPEEDEKFFKANGVPLFSSHMIDLSEEPVEENISTCVKYLKRMAPMKQWLEMEIGITGGEEDGVDNSEVDNASLYTQPEDIWQIEEDSRPISPYFSIGAGFGNVHGVYAPGNVKLHPDLLGKQQAYVPEKLGGKDKKPFFFVFHGGSGSSKEEYREAISNGVVKVNVDTDLQWSYLVGIRDYILNNIDYLRSQVGNPEGPNKPNKKKYDPRVWIREGEKTMKARVEEGPQGPSNTTVTV

SEQ ID NO: 15741 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 15742 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 15743 - protein, 503 aa, Methanosarcina acetivorans C2A
MVLYSLFQGDFVVQEYKLHIGGESRDSATGETFDNINPATLENLATVQVAGSEDVDRAVEAAEEGFRVWSEVPAPRRAEVLFRTARILQERKEDLARLMTEEMGKVLPETRGDVQEAIDIAIYAAGEGRRMFGETTTSELKDKFCMTVLRPIGVVGMITPWNFPLAIPGWKIMPALIAGNAIVFKPASDTPLLAIKLVEILMEAGLPPGVVNLVTGPGGSTGKAIVQHPRIKAISFTGSLETGKWIMEECAKTMKRVSLELGGKNPVIIMDDADLELALEGVLWGAFGTTGQRCTATSRLILHEKIKDEFTARLLAKTKLLRVGNGLLPETDIGPIINKAQLEKIERYVRIGMEEGATLLLGGKAIDPGLPGYFFEPTVFTDVRPDMRIAQEEIFGPVLSIITVSGLEEAIEVANNTRYGLSSAIYTENVGKAFRAVKKIEAGITYVNAPTIGAEVHLPFGGVKGTGNGFREAGTEAIKEFTEIKAVYIDYSGRLQRAQIDME

SEQ ID NO: 15744 - protein, 377 aa, Nepenthes alata
AVIGSGVLSLAWAIAQLGWIAGPAVMLLFSFVIYYTSILLADCYRVDDPIFGNRNYTYMDAVRSNLGGVKVKVCGLIQYLNLIGVAIGYTIAASISMMAIRRSNCFHNSGAKKPCHMSSNPYMIMFGILEIILSQIPDFDQIWWLSIVAAVMSFTYSTIGLSLGIAQVAANKAFKGSLTGISIGAVTQTQKIWRSFQALGDIAFAYSYSIILIEIQDTVKSPPSEAKTMKKASLISIVVTTAFYMLCGCMGYAAFGDIAPGNLLTGFGFYNPFWLLDIANAAIVVHLVGAYQVYCQPLFAFVEKSASGKWPKNAFINKGIKIQIPGFGAYDLNIFRLAWRTAFVITTTIISMLLPFFNDIVGILGAFGFWPFTVYFP

SEQ ID NO: 15745 - protein, 172 aa, Clostridium tetani E88
MDLKDKIRVIQGFPKEGISFKDVTTILQEKEAFKYTIDTLVEELKDKNVDVVVGPEARGFLFGAPLAYALGAGFVPVRKKGKLPSTTISSKYELEYGSDELEMHKDSIKPGQRVVIADDLLATGGTICSVIEMIESLGGEIVSINFLIELTDLKGREKLGKYDISSLVQYDI

SEQ ID NO: 15746 - protein, 522 aa, Arabidopsis thaliana
MATEPTRSWFQIRQQKPDKSSPTKKGQEGNVKNLGRPPMNDAPSNATKQKVAAAKQYIENHYKIQKKSLQERKERRSILEQNLADADVTVEDKMDILKNFEKKEMEYMRLQRQKMGVDDFELLSIIGRGAFGEVRICKEKSTGSVYAMKKLKKSEMLRRGQVEHVKAERNVLAEVDSPFIVKLCYSFQDDEHLYLIMEYLPGGDMMTLLMRKDTLREDETRFYVAQTILAIESIHKHNYVHRDIKPDNLLITRNGHIKLSDFGLSKSLESKNFPDFKAELVDRSTKPAAEHDRLSKPPSAPRRTQQEQLLHWQQNRRTLAFSTVGTPDYIAPEVLLKKGYGMECDWWSLGAIMFEMLVGFPPFYSEEPLATCRKIVNWKTCLKFPDEAKLSIEVKDLIRRLLCNVEQRLGTKGVHEIKAHPWFRGVEWERLYESNAPYIPQVKHELDTQNFEKFDEVPSTCQTSSKSSPWRKMISSKDANFLGYTFKNLEIVDEHHIPGMAELKRKSKTANKPSLKTLFGKK

SEQ ID NO: 15747 - protein, 421 aa, Symbiodinium muscatinei
MPSAVENVALLFGGAVATTALSSAFVASGPVAQEAKTGLRAAGYAKSSQSSSQSMGAMAGVGAVAGLAVAGVAGRRAGKNRTSMEAVGVGINGFGRIGRQVARIAMKDPETELKLINASYDSDYLAYMMKYDTIHGKYDGTVEADGDSLIVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVCWYDNEWGYSSRVVDLIKHMAAEDAKA

SEQ ID NO: 15748 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLPQILLRPAEYDVIACMNLNGDYIYDALAAQVGGIGIGPGANIGEECSLFEATHGAAPKYAGQDKVNPGSIILSAEMMMRHMGWTEAADLIVKGMEGAINAKTVTYDFERLMEGAKLL

SEQ ID NO: 15749 - protein, 175 aa, Triticum aestivum
MAPAVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 15750 - protein, 742 aa, ASPERGILLUS NIDULANS FGSC A4
MYHDHPVRSVQDLIGFSGLISHAIRHPLDFHYSVGPTLSELSGGLLSSSFEPERDLPGLSGKVIFVTGGNTGLGKETVLQLARHRPERIYLAARTAIKATNAIASIQEALPCRADIRHIPLDLASFASIRAAAKQFQAECERLDILILNAGVMGHPPSLTEEGYEIHLGTNHIGHFLLTKLLLPTLRETVSRSESPDVRVITLSSLAANTAPSYDSITSTPALLSLGWASRYGASKAANVLFAAELARRHPEILSVSVHPGAVVTDLYQQTKKAGLFYEAGVGLMMKFFRSIRTGALTQIWAAAAPREQLINGGYYVPIAVKGVSRYHQYLPDLSLPRFQVMRNQDAHEYAEAFKKGRNPPWLHALYTHWKDLAQEPFKGVTTDGNVRPNLFTLQDEQVPIDTIVSATKHLFSLLSPDQQQTLSYHIDSPEWRTWSNPEFLLSHKGLRLDEVNPEIRDAILAVLQATLSPEGYDKAIKAMRINHFLGELVESPRVMNEYSYNFVLFGNPSTTRPWGWSFYGHHLCLNIFLYKSQIVASPWFTGAEPNLIDSGPYSGTRILHVEETLGLKLMQSLPPHIQRKAQTYALMKDPAMPPGRWNRDDQRHVCGAYRDNRIVPNEGVPVTLFTEDQKATLYEILNQYLLYLPTYARALRIAHIKQYESETYFSWIGGYGDHDPFYFRIQSPVILVEFDHHSGVFLNNEEPKKFHIHTLLRTPNGGDYGFALRPLVPPIEDANGKEISW

SEQ ID NO: 15751 - protein, 403 aa, Oryza sativa (indica cultivar-group); identical to SEQ ID NO: 12318

SEQ ID NO: 15752 - protein, 789 aa, Fusobacterium nucleatum subsp. nucleatum ATCC 25586
MKFDKEEWKEKLEERLLEKFSVSLKDASPFEVYRALGETVMSFIAKDWYETKQEYSKTKQAFYLSSEFLMGRALGNNLINLGIDKEIQKFFKELGIDYNQIEDEEEDAALGNGGLGRLAACFMDSLATLNLPGQGYSIRYRNGIFNQYLRDGYQVEKPETWLKYGDVWSVMRPEDEVIVNFGHTSVRALPYDMPIIGYGTNNINTLRLWEAHSIVDLDLGVFNQQDYLHATQDKTLAEDISRVLYPNDSTDDGKKLRLRQQYFFVSASLQDIIKKFKKVHGREFSKIPEFIAIQLNDTHPVIAIPELMRILVDVEGVLWEDAWEIVKKTFSYTNHTILAEALEKWWIGLYQEVVPRIFQITEGIHNQFKNELANLYPNDINKQNRMQIIQGNMIHMAWLAIYGSHKVNGVAELHTEILKEHELRDWYELYPEKFLNKTNGITQRRWLLKSNPQLASYITELIGDAWIKDLSELKKLEQFMNDEKVLNKIWDIKIEKKEELVEYLRETQGIDINPKSIFDVQVKRMHEYKRQLLNIFQVYDLYQQLKQNPNMDFTPTTYIYGAKAAPGYKIAKGIIRLINDIAQIINADGDVKEKLKVVFVENYRVTVAEKIFPAADISEQISTAGKEASGTGNMKFMLNGAITLGTLDGANVEIVKEAGEENEYIFGMRVKDIDELRKKGYDPRFPYNNVTGLKQVVDALIDGKLSDLGSGIYREIHSLLMERGDQYFVLEDFEDYRRKQREINRDYKDKISWAKKMLKNIANAGKFSSDRTILEYANEIWNIKETKIK

SEQ ID NO: 15753 - protein, 246 aa, Oryza sativa
  unsure (1)..(246): unsure at all Xaa locations
VGDEQEDLVCPRTRLQNAVWSWLYKWVEPVMSSWAMSKLRGRALDRLMXHIHYEDENTQYLCICSVNKALNMVCCWAEDPNSDAFKRHLARVPDFLWLSEDGMKAQVYDGCQSWETALIIQAFCATDLVNEYASTVQRAHEFMKNSQVVRNHPGDQSYWHRHRSKGSWTLSSADNGWAVSDTTAEALKKSDIISFQAHGLGIPFERERLYDAVDCLLSFQNKDGTVSTYECKRTSTWIEVSFCTLS

SEQ ID NO: 15754 - protein, 183 aa, Methanosarcina barkeri
MSESSIKIENVVASTKLAEEFDLTVIESKFEGAEYNKQKFPGLVYRVSDPKAAFLVFTSGKVVCTGAKNVADVHTVIGNMAKKLNSIGITTIENPQITVQNIVASADLHTILNLNAIAIGLGLENIEYEPEQFPGLVYRIDDPKVVVLIFSSGKLVVTGGKTPEDCERGVEVVRQQLDNMGLL

SEQ ID NO: 15755 - protein, 202 aa, Zea mays
ECSLFVGEVVVSPPYVFLPVVKSQLRQEFQVAAQNCWVKKGGAFTGEISAEMLVNLGVPWVILGHSERRALLGESNEGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDII

SEQ ID NO: 15756 - protein, 236 aa, Glycine max
MGGGTIMTTITSHRVPQFRNTLNNFSSPSPSSSAPKLNPALSTTNTLSCTCSVSHTQLCTNQPAPSQREVEDAVSSLQEFMQAFQQISGFYDSRGVMSHGYKRLYDAFQLLQADPTIKRLVVSLSSDKALWDAVMSNVRHQKKLLELPDSVDCRRPQIFELNEFGIQILSWTLDIIKGKILELIESFQSLVNDLFQSPKMGNATTIATERDEKVRSSFLLSILILLIIIAARSQRF

SEQ ID NO: 15757 - protein, 245 aa, Rhodobacter sphaeroides
MRDFVGKRYWLIGGSEGLGLALAKKLSGAGAKVILSGRDEARLAEAVAAMPAPAEAVTLDVTSEASIEAALAQVGAFDGVVYLAGAYWPMKAQAWEASRVEAMIDTNLLGLVRLLSAVLPGMIAANRGHLVVTGSIGGYRGLPGAIGYSASKAGVMALTESLYADLRDTGVEVQLVNPGFIRTRLTEKNRFRMPFIMEPEAAAQRMFEHMCADNFRANFPVLFASFFRFSQLLPDGLFYRLLGKG

SEQ ID NO: 15758 - protein, 318 aa, Oryza sativa
MRNPPGRHLLRVATRAVRSSSALGSGGGGGGASTSATSPVAASSSSGGRPRTRSGGRLLRATSPPPPSAIAAAACWESRTMRREGEEEWEEVVAGAEEAVHGAPVPVAEEEEEYRVVFWSPPTGDEVRAAFTSIEEVFGDPFRAHSYETEEQSALSTSVHSSSGNSSGSDDWIEPAAYALNSTALLTREHRNVLDAFRLLQKDPNVQKMVMSLSCDRAVWDAVMNNEAVQEFRRSFQDDKEAAGRKGNPGGPAGVLKWILGNTQAKIMEFMNNIMKIVNMLFHSDDDEAKPDLYTDAVKVSFMLSVFIFIVVAIARIK

SEQ ID NO: 15759 - protein, 411 aa, Synechococcus sp. PCC 7942
MGDRKGAVMILSYSAAIELLLAEVAQLPLAIERVPLLETGDRLLAKDLAAPCDLPHWDNSAMDGFALRSQDVAAASPDRPVRLPVVGRVMAGEQPPLLANPTGVACAVMTGAPIPAGFDVIVKVEDVVQEENAIAVSTPIPAGQFIRRQGEDLRQGSPLLAKGQRLTPMALMLAAAVGMGELPVWSKLPVGLISTGTEVVPWSQPTLELGQIRNSSQPFLIEQLQRLGCEVRAIAHVPDDPEQFAAIAQQFWSQGVRLLLTTGAVSMGVADFVPAALERLGCQTIFHKVAIRPGKPLLFAIAPEHQGLVLACPGNPVSTTVTAEFFLKPLLMACRNEVRSPLWLPLAESVRKPEGLQCFWRSRLTPEGKVWVDPQQSSAALKSLVESTHWAILPAGQDFLAAGTPVEVRSL

SEQ ID NO: 15760 - protein, 76 aa, Glycine max
  unsure (1)..(76): unsure at all Xaa locations
QXQNXRLAAEDFLPKPAKGQTDKEGWNPPGKGEAPQTQTNSGKSDXTPRQXKEHASDANTDNFLAKEDKKSPKTTI

SEQ ID NO: 15761 - protein, 323 aa, Zea mays; identical to SEQ ID NO: 12637

SEQ ID NO: 15762 - protein, 329 aa, GIBBERELLA ZEAE PH-1
MSPHSASTTVNELVNEYADIIKGKVILTTGVTLNSLGGLFIQETASKSPELLILAGRNASKLQELAEAIAKGYPSVKTRNLVVDLSSLASVRKAAEGVNSWEDVPVIDVLVNNAGIMAVPYAKSVDGFESQFAICHLSHFLLTNLIMDKILASKSPRIVNISSNVHSLGPVRFADPHFSNGETYNEWSAYGQAKTSNALFSISLAQKLGGRGLQSYSVHPGLILTTGLGTHLDFASMEGDLGAIIKAHRERGNTEGWKFLDPVPVEVGAATHAFAAFDPNLRANNGAYLLETRVSDPFVDTYKSWARDPVDAEKLWRLSEELVGQKFGY

SEQ ID NO: 15763 - protein, 128 aa, Salmonella enterica
HMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 15764 - protein, 108 aa, Oryza sativa
  unsure (1)..(108): unsure at all Xaa locations
RQSDQGPSTPRSKHSATXQRRXTKINDRLXILRELLPHTDQKRDKASFLSEVIDYIRFLQVQVQKYEEADPERKSRGIPKCIVQQGLTIDHHWWSQDTSVPRGEGLPS

SEQ ID NO: 15765 - protein, 495 aa, Rhizobium etli
MAISSTLLGRLKDQTLVREQMLVGGKWSSEGVNGTRINVLNPSTMDVLASLPSAGLAEVRASIDAAKAAQKKWAKVSAKERSLIMRKFYEEVVANAEDLAVILTSEMGKPLAEARGEIAYGASYIEWFGEEAKRVYGDTIPGHQADKRLLVIKQPVGVVAAIAPWNFPSAMVCRKIAPALASGCAIVFKPAAETPLSALALAILAERAGIPDGLFSVLPTDNARMFGEEVCSNPVVKKLTFTGSTEVGRILMAQGAQKIMKLSLELGGNAPFIVFDDADLDQAVEGAMLSKFRNAGQTCVCANRIYVQSGIHDRFVEKLAMRVSALQVLDGFESGATIGPLINDEAVAKLYGHIDDAVTKGATVVVGGDRDARGGTFVQPTLLSGATKDMKVAREETFAPLAPVFKFDTVEEVIELANDTEFGLAAYFFANDLRNVWKVTEALEYGMVGVNTGLISTELAPFGGVKQSGFGREGSKYGMDDFLSMKYVCMGGIGA

SEQ ID NO: 15766 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 15767 - protein, 321 aa, Synechocystis sp. WH 8501
MVENRQSTVVITGASSGVGLYAAKALADRGWYVVMACRNQPKAHQAAQSLGIALDAYTVMHIDLGNLDSVRQFAQDFRATGKTLDALVCNAAIYMPLLKEPLRSPEGYELSMTTNHLGHFLLCNLMLEDLSHSSAPEKRMVILGTVTHNPDELGGKIPPRPDLGNLEGFADGFKEPISMVDGKNFEPVKAYKDSKVCNVLTMRELDRRYHESTGIVFTSLYPGCVADTPLFRNHYPLFQKIFPWFQKNVTGGYVSQELAGERVADVVTKPEYGESGSYWSWGNRQKKDRQAAFVQNVSPQAQDEAKAEKMWNLSEKLVGLA

SEQ ID NO: 15768 - protein, 196 aa, Buchnera aphidicola (Schizaphis graminum)
MANILLLDNFDSFTYNLVEQLRNKNSNVLIYRNTVDINTILNSIKKIRNPILMLSPGPSTPKNAGCMLNLIKKVKGEIPIVGICLGHQAIVEAYGGIIGYAGEIFHGKASLINHDGLEMFEGLPQPLPVARYHSLICNKIPKNFIINSYFNDMIMSVRNNLDYVCGFQFHPESILTTSGALLLEKIINWASLKYKG

SEQ ID NO: 15769 - protein, 303 aa, Bradyrhizobium japonicum USDA 110
MPPNDNRIDARDWSLLAVLSILWGGSFFFNSAGLRELPPLTLVFLRVALGAAVLLPLLHVQGISFPKGTLGWKPFFVIGLLNNVIPFSLIVIGQTIIPSGLASILNATTPLFTVTVMAMAGEEALQMRRVAGVVLGVVGVVILRGWGIETRPGQGFGILLCLGGACSYGFAALAARRLLKDSAPLGTATFQLMASTVMMAVVAAVMEQPWHLPAPGLTTWLAVLGLAGLSTALAYIVFFQILRRSGATNVMLVTLLIPVTAILLGWLVLGEPISMREIAGAIVIGSALLVIDGRALRMLQRVA

SEQ ID NO: 15770 - protein, 667 aa, Nicotiana sp.
MAAAAPSPSSSAFSKTLSPSSSTSSTLLPRSTFPFPHHPHKTTPPPLHLTHTHIHIHSQRRRFTISNVISTNQKVSQTEKTETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPVLIDVPKDIQQQLVIPDWDQPMRLPGYMSRLPKLPNEMLLEQIVRLISESKKPVLYVGGGCSQSSEDLRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTEQKVKHPLNFKTFGDAIPPQYAIQVLDELTNGNAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGNPAARVTHRDDLRAAIQKMLDTPGPYLLDVIVPHQEHVLPMIPSGGAFKDVITEGDGRSSY

SEQ ID NO: 15771 - protein, 419 aa, Polyopes tasmanicus
ETDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAVVIARNEGRDYVTEGPQILQDAAKTC

SEQ ID NO: 15772 - protein, 161 aa, Zea mays
MDGRMFGLETPLMVALQHLLDVPDGDAGAGGDKAGGGGPTRTYVADARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 15773 - protein, 454 aa, Burkholderia fungorum
CLFCSFCSSVRVVRFVCLSVVVLLRLLRCHAHGSIGTRLIDRSRLPCPARGGAQAPVARCSEQDRSALQGRCDGYAACFAIKSPKRCRRHRNSFQSKELSMPLVSMRQLLDHAAENGYGLPAFNVNNLEQVQAIMAAADKVNAPVIMQASAGARKYAGEAFLRHLIEAAVESYPHIPVVMHQDHGQSPAVCMAAIRSGFTSVMMDGSLEADGKTVASYEYNVDVSRRVVEAAHSIGITVEAELGVLGSLETMKGDKEDGHGAEGTMTREQLLTDPEQAADFVKLTQCDALAIAIGTSHGAYKFSKKPTGDILSIQRIKEIHQRIPNTHLVMHGSSSVPQELLAEIREFGGDMKETYGVPVEEIQEGIKNGVRKVNIDTDLRLAITGAIRRYMATNPGKFDPRDYLKPAREAAMKICIERYTQFGCEGQAGKIKPVTLDKIAEKYKSGELAQVVR

SEQ ID NO: 15774 - protein, 237 aa, Zea mays
  unsure (1)..(237): unsure at all Xaa locations
MAAAAVAADSKIDNLRDAVAKLREISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNXSGKLDTLLSQGKXEYVFVANSDXLGAIVDIKI

SEQ ID NO: 15775 - protein, 472 aa, Oryza sativa
MAFSSEAWKSSATAGHGDGDGDGDRTPPPTPPLPTPLLPPTLAPLQRSLVFGRVEGEAMSSEARESSATAVDRTPPPTPPSPPPPPPPPPTNGTLTPPPSSAPSGGRATSSEARESPHATSVDDGGRAPPPPPLPRPTSARATPATTPSADGSSSSSSSTSGGDEDKDSFMHLVSRYLIREEKEMIDWNKVERPTPEMVVPYDSLVQAPRDIPEIRNLLNKLAVLKLNGGLGTTMECVAPKRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKGEVTIAAQLGLKLDILDGSVFDNKHSTHSSGAIKYTMKLDEGADCASIDSALNRLNPGSTLILKKDDFYRYIDPIQARNRAMFHSESRYNPYPLLPSLLHLALHHCFPYITLEPVERLTGIHDLFS

SEQ ID NO: 15776 - protein, 372 aa, Arabidopsis thaliana
MSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 15777 - protein, 147 aa, Zea mays
  unsure (1)..(147): unsure at all Xaa locations
RSPYKEERSVGSQKICGXQLKGCVQMLCVDQYPIVLMEDPLDQTRXLHYPKMTNAIGEKAQIVGDDLVLTNPTRVTQAITEKSFNALLLKANQIXSATESIDGVKTXRRAPWGVMTSYRSXRLXDTFIADQADWLNTLQINTGAPCT

SEQ ID NO: 15778 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 15779 - protein, 551 aa, Pholiota nameko
MASYQEKSSDRDSHEKVVPANSGYVLGERRRAALAEVDNAKFSWFHAKVCIVAGVGFFTDAYDIFAINIASTMLGYVYGSGKPGALKALNKQQDLGVKVATPVGTLVGQLLFGWLADLLGRKKMYGVELMIIIIATFAQALSENAPAVHIIGVLVVWRFIMGVGIGGDYPLSAVISSEFASTKIRGRMMTAVFASQGWGNFTAALVGFIITAAYKSSILKEASITNLHSVDVMWRLLIGLGAVPGVVALYFRLTIPETPRFTMDIERNIDQAATDIQAVLAGRKSHVDDDAFIQRIEAPKASWADFREHFGKFENFKILFGTAYSWFALDIAFYGLGLNSGIILQAIGFGNPTSTGTQAIYDNLKNICVGNLILSAAGLIPGYWVSFLFIDKWGRKPIQLMGFIALTILFVILGFGYDKLISTPSSKKAFVFLYCLADFFQNFGPNTTTFVIPGEIFPTRYRSTAHGISAASGKLGAIVAQVGFSQLKDIGGPSAWVKHILEIFAFFMLTGIGSTLLLPETKNRTLEDLSNENQEGFVRGTSNKTAVITDA

SEQ ID NO: 15780 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 15781 - protein, 189 aa, Aeropyrum pernix
MEGLPKPEVKIENIVATVILENQLDLNLIETKIQDVDYNPDQFPGLVYRLESPRVTVLIFKSGKMVITGAKSINQLIHVVKKLLKAFADQGIPISGKPQIQIQNIVASANLKVYIDLEKAALEFENSLYEPEQFPGLIYRMDEPRVVMLIFSSGKMVITGAKMENEVYDAVKKVARKLKEADAIIGIAE

SEQ ID NO: 15782 - protein, 232 aa, Oryza sativa (japonica cultivar-group)
MTVVDAESRFHVLAVDDSLIDRKLIEMLLKNSSYQVTTVDSGSKALELLGLRDEGDDSSSSPSSSSPDHQEIDVNLIITDYCMPGMTGYDLLKRVKGSSSLKDIPVVIMSSENVPARINRCLEDGAEEFFLKPVKLADMKKLKSHLLKRKQQLPMAAAAPDKPPHKPDEAAASAAAIAEAATAQTDGIISDCSCSGSSKRKAAAMEQEVISSPDQRTKPRLSSTSSGLAVET

SEQ ID NO: 15783 - protein, 94 aa, Schizosaccharomyces pombe
MKVKILRYHAIANWTWDTPKDDVCGICRVPFDGCCPQCTSPGDNCPIVWGKCKHIFHAHCIQNWLATSGSQGQCPMDRQTFVVADSTNEKSETQ

SEQ ID NO: 15784 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 15785 - protein, 521 aa, Pueraria montana var. lobata
MLLELALGLLVLALFLHLRPTPTAKSKALRHLPNPPSPKPRLPFIGHLHLLKDQLLHHALIDLSKKYGPLYSLYFGSMPTVVASTPELFKLFLQTHEATSFNTRFQTSAIRRLTYDNSVAMVPFGPYWKFIRKLIMNDLLNATTVNKLRPLRTEQIRKFLRVMAQSAEAQQPLNVTEELLKWTNSTISMMMLGEAEEIRDIAREVLKIFGEYSVTNFIWPLMYLKVGKYEKRIDDIFNKFDPVIERVIKKRREIVRRRKNGEVVEGEASGVFLDTLLEFAEDETMEIKITKEQIKGLVVDFFSAGTDSTAVATEWALAELINNPRVLQKARDEVYSVVGKDRLVDEVDTQNLPYIRAIVKETFRMHPPLPVVKRKCVEECEVNGFVIPEGALILFNVWAVGRDPKYWDRPLEFRPERFLESGAEGEVGPIDLRGQHFQLLPFGSGRRMCPGVNLATSGMATLLASLIQCFDLQVVGPKGEILKGNDAKVSMEESAGLTVPRAHNLRCVPLARTSVAAKLLS

SEQ ID NO: 15786 - protein, 61 aa, Glycine max
  unsure (1)..(61): unsure at all Xaa locations
LMNHIEELKFASKSLQRQSRKCEEEEKSDKQKMKKAVTKGCMAGTHIYAAKAIRERXEQMN

SEQ ID NO: 15787 - protein, 165 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 15788 - protein, 158 aa, Chrysosporium lucknowense
GAFDNERVVLPLTQYDMVIDRDSPRPGQQAFEKMTAGLYLGEIFRLVLLDLFDNKGKLIFEGQDVSGLRKPYCLDSSFLAHIEEDPFENLSETRDLFERTLGLKASKPELELCRRLAELIGTRAARLSACGVAAICTKKNIKSCHVGADGSVFNKYPH

SEQ ID NO: 15789 - protein, 447 aa, Agardhiella sp.
ALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRMPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVLARNEGRDYVTEGPQILQDAAKTCGPLQTALDLWKDITFNYTSTDTADFVETPTANV

SEQ ID NO: 15790 - protein, 348 aa, Ostreococcus tauri
KLQAEWKAAKLARKQICKDYIKKVTDIDVPIDSMFDVQVKRIHEYKRQLLNILGIIYRYKQMKAMTPEERAKCVPRVCIFGGKAYATYMQAKRIVRLINNVGSIVNNDPEIGDLLKVVFVPDYNVSLAETLIPASELSQHISTAGTEASGTSNMKFQMNGCLIIGTLDGANVEIRECVGEDNFFLFGITDPEVEPARKERAEGKFVPDKRFTEVVEYVRSGVFGDKFEELLGSLEGNEGFGRGDYFLVGKDFASYLEAQERVDEAYRNQQGWTESSIISTGYSGKFNSDRTIDQYAKEIWGITPARARRSKRRGYKIHLGAHAQMRWHGLVFERGPRRLEGAVLLTAG

SEQ ID NO: 15791 - protein, 305 aa, Glycine max
MAATSTSLFFSNLHSLNPQPFSSSLSFFRNVHSTLSFPSSSKPSRGVVAMAGSGKFFVGGNWKCNGTKDSISKLVSDLNSATLEPDVDVVVAPPFVYIDQVKNSITDRIEISAQNSWVGKGGAFTGEISVEQLKDLGCKWVILGHSERRHVIGENDEFIGKKTAYALSEGLGVIACIGELLQEREAGQTFDICFQQLKAFADAVPSWDNIVIAYEPVWAIGTGKVATPEQAQEVHAAVRDWLKKNVSAKVASKTRIIYGGSVNASNSAELAKQEDIDGFLVGGASLKGPEFATIINSVTSKKVAA

SEQ ID NO: 15792 - protein, 475 aa, Ralstonia metallidurans
MRQQQGFDAIVEREQGLHRGLSTGQLSMIAIGGAIGTGLFLGSGFAIGFAGPSVLVSYAIGALIALLLMGCLAEMTVAHPTSGSFGANAEHYIGPLAGFLVRYAYWSSIVFAVGTEVTAIAVYMKYWFPMVPGWYWIVGFSAALIGINATSVKVFGAVEYVFSMLKIVAIVGFILLGAYVVTRAPTGSGIGLANYTAHGGFFPKGMWGTWVAVIVSIFSYLSIEMIAVAAGEARDPETAITRAFRATMVRLVFFYLLTLALMLMIVPWTAAGAGESPFVRVMAATRVPGAAAVFNFVILVAALSAMNSQLYITTRMMFSLSRAGYAPKALGQVNGRGVPMTALLLSTVGIAFAVVLNVVYPDASFMLMMAISMFGAMFTWLMIFITHLFFRRQHRGRPLAFRMWGFPVTTLLGAGLMFATLVTTWFTPEFRMTLVAGVPFMLALSAAYWLWYRKRGGAAQGDGEDAGRAEVRNSW

SEQ ID NO: 15793 - protein, 505 aa, Pseudomonas syringae pv. tomato str. DC3000
MHDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 15794 - protein, 275 aa, Escherichia sp. Souza-57
IGQALALLLKTQLPAGSELSLYDIAPVTPGVAVDLSHIPTAVKIKGFSGEDARPALEGADVVLISAGVARKPGMDRSDLFNVNAGIVKNLIQQVATTCPKACIGIITNPVNTTVAIAAEVLKKAGVYDKNKLFGVTTLDIIRSNTFVAELKGKQPTELEVPVIGGHSGVTILPLLSQIPGVSFTEQEVADLTKRIQNAGTEVVEAKAGGGSATLSMGQAAARFGLSLVRALQGEQGVVECAYVEGDGEHARFFSQPLLLGKNGIEERKSIGTLSA

SEQ ID NO: 15795 - protein, 224 aa, Glycine max
FGWDKAFFVEHPQYAKNDFFITGESYAGHYIPAFATRIHRGNKAKEGIHINLKGLAIGNGLTNPAIQYKAYPDYALEMGIIKKATRNLLNLVLVPACESAIKLCGTNGKTSCMAAYVVCNVIFSDIMLHAGDTNYYDIRKKCEGSLCYDFSNMDKFLNQQSVRDSLGVGKIHFVSCSTEVYLEIMHMRHKFDVDTRLVEGIVLDHGSRHPDMKRRAENWLYLDM

SEQ ID NO: 15796 - protein, 450 aa, Hordeum vulgare subsp. vulgare
MAMPPAEKVIVVDANPSKNGHGDEIDDLPVADATSHQIGVDPWYQVAFVLTTGVNSAYVLGYSGSLMVPLGWVGGTVGLLLAAAVSMYANALLGRLHLLGGKRHIRYRDLAGHIYGPKMYRLTWAMQYVNLFMINTGFIIIAGQALKALYLLISNDGAMKLPYCIAVSGFVCALFAFGIPYLSALRIWLGFSTVFSLTYIVAACTLSLKDGMRSPPRDYSIQGDPSSRVFTTIGAAASLVFAYNTGMLPEIQATVRAPVVKNMEKALWFQFTAGCVPLYAIIVIGYWAYGNQTTTYLLNNVHGPVWIKAVANLSAFLQTVIALHIFASPMYEYLDTRFGSKVGGPFAMHNVIFRVGVRGGYLAVNTLMAAMLPFLGDFMSLTGALSTFPLTFVLANHMYLVSNRQRLSSLQKSWHWLNIVFFTILSITAAIAALRLIARDSKEYHIFADV

SEQ ID NO: 15797 - protein, 473 aa, Zea mays
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 15798 - protein, 328 aa, Zea mays
MGVKGFVEGGIASIVAGCSTHPLDLIKVRMQLQGEAAAAVAPQPALRPALAFHAGGHAVALPHHHHHDIPAPPRKPGPLAVGAQILRSEGAAGLFSGVSATMLRQTLYSTTRMGLYDILKTRWARENGGVLPLHRKILAGLVAGGVGAAVGNPADVAMVRMQADGRLPLAERRNYRGVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 15799 - protein, 460 aa, Phycodrys ovifolia
WDPEYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMENMYERAEFAKQLGSIIIMIDLVIGYSAIQSMGIWARQNDMILHLHRAGNSTYSRQKIHGMNFRVICKWMRMAGVDHIHAGTVVGKLEGDPLMIKGFYDTLLLPYLEVNLPEGIFFKQDWAALRKVTPVASGGIHCGQMHQLLDYLGNDVVLQFGGGTIGHPDGIQAGATANRVALESMVIARNEGRPYVQEGPEILRDAAKTCGPLQTALDLWKDITFNYTSTDTADFVASPTANV

SEQ ID NO: 15800 - protein, 297 aa, Escherichia coli
MMNLKAVIPVAGLGMHMLPATKAIPKEMLPIVDKPMIQYIVDEIVAAGIKEILLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGELSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSK

SEQ ID NO: 15801 - protein, 359 aa, Synechocystis sp. WH 8501
MALVPMRLLLDHAAENGYGIPAFNVNNLEQILAIMQAADETDSPVILQASRGARKYAGENFLRHLILGAVESYPHIPIAMHQDHGNSPATCYSAIRNGFTSVMMDGSLEADAKTPASFEYNVNVTAEVVKVAHAVGASVEGELGCLGSLETGKGDKEDGHGFEGTLSKDQLLTDPDEAVEFVERTQVDALAIAIGTSHGAYKFTRKPTGEILAISRIEEIHSRLPNTHLVMHGSSSVPQEWLDMINEYGGQIPETYGVPVEEIQKGIKSGVRKVNIDTDNRLAITAAIREAAVKDPANFDPRHFMKPSMKYMKQVCSDRYQQFWTAGNASKIKQESLDAYSDKYAKGELSAGTKKTVAV

SEQ ID NO: 15802 - protein, 153 aa, Corynebacterium glutamicum ATCC 13032
MTALVIVASTRAAAGVYEDRSGPILVSWLRAKGFDTPAPVIVADANLPAFLDELEFPQVVLISGGTGLTPDDITVDTLIPRLDKEIPGIAHAFWNYSMDAVPTAVLSRTVAGTIGGSFIMALPGSTGAARDATAVLDPLIDHITGTLQGHHEH

SEQ ID NO: 15803 - protein, 338 aa, Cyanidium caldarium
MPNRQDCNLEANKISSQLALTFYYDMLLGRGFEDACAQMYYRGKMFGFVHLYNGQEAISTGVIKSLKTTDYVCSTYRDHVHAISKGVPPRSVMAELFGKETGCSRGRGGSMHLFSSFHRFLGGFAFIGEGIPIALGSAFKSMYSQQVCKSVQELDVTVCFLGDGATNNGQFFECLNMAGLWNLPVIFVVENNQWAIGMAHHRSTSQVEIYKKAAAFGINSCEVDGMDVVAVHKTAKEAILKARKGDGPTLIEALTYRFRGHSLADPDELRSKNEKDIWISRDPIKNFQSYVIRNKLLSQKQLIKVKDEVTQTINDALQFAIISPEPKLQDLHKYVFTH

SEQ ID NO: 15804 - protein, 451 aa, Gelidiella acerosa
  unsure (1)..(451): unsure at all Xaa locations
TDVLALXRVXPQPGVXPVEASAAVAGEXSTATWTVVWTDLLTACDLYRAKAYKVVEVPNTTDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEIKGHYMNVTAATMEDMYERAEFAKQLGTIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALEAMVIARNEGKDYVAEGPQILRDAAKTCGPLQTALDLWKDITFNYTSTDTADYVETPTANV

SEQ ID NO: 15805 - protein, 456 aa, Solanum berthaultii
  unsure (1)..(456): unsure at all Xaa locations
MVLAFIVFVLMLLLTDVVSSHFIVETLPGFDGQLPFKLETGYIGVGEEEKLQLFYFFVESERDPQNDPLMIWLTGGPGCSGLSTFLYEFGPLTFDYANSSGNFPKLELNLHSWTKVANIIFIDQPVGTGYSYAKTSEAYNSNDTLSATLTYDFLRKWLMDHPEYLKNPLYVGSESYAGIYSALVTRKIYDGVEVGDEPQMNIKGYIQGNALTDAYITVNSRVKYVYHMGLISDKIYQSAKANCNGNYVDIDPNNILCLNDLQKVKKCLNNIQSHHILENWCDLSLLRSNVHSGPWCRENNYIYSKIWANDKAVQKALNVREGTILEWVRCNNSMKYSARESMKRSGSYVYEIQSSIDDHRHLTSKSCRALIYSGDHDMIISHVSTEEWIDTLKLPIVDDWEPWFVEDQVAGYKVKYLQNDYELTYATVKGAGHTAPEYKPRQCMSMVDXWFSGDPL

SEQ ID NO: 15806 - protein, 254 aa, Triticum aestivum
  unsure (1)..(254): unsure at all Xaa locations
MGRKFFVGGNWKCNGTTDQVEKIVKTLNEGQVPPADVVEVVVSPPYVFLPVVKSLLRPEFHVAAQNCWVKKGGAFTGEVSXARCSVNLGVPWSSLGHSERRALLGESNEFVGDKVAYALSQGLKVIACVGETLEQREAGSTMEVVAAQTKAIAEKISDWSNVVVAYEPVWAIGTGKVATPAQAQEVHXSLRDWLKINVSPEVAESTRIIYGGSVTAANCKELGAQPDVDGFLVGGASLKPEFIDIINAATVKSA

SEQ ID NO: 15807 - protein, 527 aa, Brucella suis 1330
MSNLSAVFRLMRAGWILTREGVISALPVEGLSGLPALGHRIAGFLARPRARQMERSERMSRAMNKLGPSYVKLGQFLATRPDIVGHDVAADLELLQDRLDFFPQAGAVAAIEGSLGRKIDDLYVRFDAPIAAASMAQVHPAEVMKDGAPQKVAVKVIRPGVRQRFARDLESFFMVARMQERHMPFTRRLRPVQVVETLSQTTRIEMDLRLEAAALSEIAENIKGDEGFRVPKVDWERTGRDVLTLEWIDGIKMSDIPALEAAGFDLKKLAETLIQSFLRHTLRDGFFHADMHPGNLFVDHQGLVVAVDFGITGRLDKQQRRFLAEILYGFITRDYMRVAEVHFEAGYVPYTHDVASFAQAIRAIGEPIHGQPAETISMAKLLTLLFEVTELFDMETRPELLMLQKTMVVVEGVSRTLDPHFNMWKAAEPVVGDWIRKNLGPQGMVLDAKESAYALLHFTRKTPELLQRIDRISVALDTMAANGLRFDDATAEAIGRAEAQHSRWGRIAQVVIAVSMAAIAIKLYIWL

SEQ ID NO: 15808 - protein, 516 aa, Triticum aestivum
  unsure (1)..(516): unsure at all Xaa locations
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAAMLTLGALFVTDTPNSLIERGHLEEGKAVLKRIRGTDNVEPEFNEIVEASRIAQEVKHPFRNLLQRRNRPQLVIAVLLQIFQQFTGINAIMFYAPVLFNTLXGFKSDASLYSAVITGAVNVLATLVSVYAVDRAGRRALLLEAGVQMFLSHAAIAGALGIKXRDKPDNPGHGWAILGAAMVCTYGALLPXAPGGPLGWLIPSETFPLETRSAGQSVTVCVNLLFTFLIAQAFLSMFCHLKFAIFILLSAWVLVMSVFVLFFLPETKNVPMEEMTDKVWKQHWLWKRFMDDDDQHHNIANGKNASV

SEQ ID NO: 15809 - protein, 306 aa, Serratia proteamaculans
  unsure (1)..(306): unsure at all Xaa locations
CIGCHTWSVTCKKVWTSREGMEYAWFNNVESKPGVGYPNAWEDQEKWKGGWIRKINGKLEPRMGAALGLLSKIFANPDVPALDDYYEPFDYDYQNLHTAPQDKHQPIARPRSLITGQRMKKIEWGPNWXEILGGEFSKRSKDKNFDNMQKEMYGQFENTFMMYLPRLCEHCLNPACVATCPSGAIYKRGEDGIVLIDQDKCRGWRMCLTGCPYKKIYFNWKSGKSEKCIFCYPRIESGQPTVCSETCVGRIRYLGVLLYDADRIETGGSAENDKDLYQSQLDIFLDPNDPAVIAQALKDCIPXSVI

SEQ ID NO: 15810 - protein, 127 aa, Glycine max; identical to SEQ ID NO: 10496

SEQ ID NO: 15811 - protein, 294 aa, Escherichia hermannii
IVFRAAQTRSDIEIVAINDLLDAEYMAYMLKYDSTHGRFDGTVEVKDGHLVVNGKKIRVTAEKDPANLKWNEVGVDVVAEATGIFLTDETARKHITAGAKKVVLTGPSKDDTPMFVKGANFDKYNGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEDIKKAIKAAAEGEMKGVLGYTEDDVVSTDFNGEVCTSVFDAKAGIALNDNFVKLV

SEQ ID NO: 15812 - protein, 484 aa, Pseudomonas fluorescens PfO-1
MSQNKTLTTASGAPVADNQNSRSSGPRGPLLLDDFHLIEKLAHFNRENIPERRVHAKGSGAYGTFTVTRDITQYTSAKLFSAVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLISAQGERHWVKWHYKTKQGIKNLAPADAARLAGTDPDYAQRDLFEAIERGDFPKWSVCIQIMTEAQAAAHYENPFDVTKTWSQKEFPLIEVGELELNRNPLNYFAEVEQAAFGPSNMVPGVGLSPDRMLQGRVFAYADAHRYRVGTNHQQLPVNAPRSPVNTYQRDGSMAFGSNGGAAPNYEPNSYVESPKQAPHYAEPALALSGAADRYDHREDSDYYSHAGALFRLMSDEQKALLVSNIAGAMGGVSSDVIDRQLQHFYKADPAYGEAIAKLLNVQLNEV

SEQ ID NO: 15813 - protein, 396 aa, Zea mays
MALRLNDVALCLSPPLAARRRRSRSRSSGRFVAVASMTSAVSTKVENKKPFAPPREVHVQVTHSMPPHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMRKKISMPAHLMFDGQDDKLFEHFSMVAQRLGVYTARDYADILEFLVDRWKVASLTGLSGEGNKAQDYLCTLASRIRRLEERAQSRAKKAGTLPFSWVYGRDVQL

SEQ ID NO: 15814 - protein, 230 aa, Nothotsuga longibracteata
NTGPEDVIIRVIYCGICHSDIFHTRNKMGLSHYPMVPGHEVVGIVTEIGSEVKKFKVGEHVGVGCIVGSCRICGNCNESMEQYCKNMIWSYNDVNHDGTPTQGGFASTMIVDQMFVVRIPENLSLEQAAPLLCAGVTVYSPMKHFGLTEAGKRCGILGLGGLGHMGVKIAKAFGLHVTVISSNDKKKEEALEVLHADTYLVSKDAEKMQEAAESLDYILDTIPVAHPLEP

SEQ ID NO: 15815 - protein, 397 aa, Eubacterium acidaminophilum
MDFFNVVTVQEALERIYEKFEGYELGYEECQLSQALGRVLYEDIIAMEDVPGFDRSTVDGYAIKSSDSHGSSDFMPSFLELAGSVRMGESTDLSIKSGQAAYVPTGGMLPEGADCVAMIEYVQKVGESMLTLHRPAAPLENVIRKGDDIQNGQNVLKRGKTLRPQEIGVLAALGKPSVKLFKKPRIYIISTGDEVVDAKGPVLQGQIRDINGYALEALAVESGCIVSGRALVRDSLEELRAELDRALEISDIVLISGGSSVGERDYTEKAMNSYEGEGTFIHGIAIKPGKPTIVGKARGKAVFGLPGHPVSAMIVFNAIVKKLIKRMSESEAAENFITAIMDMNVHSSPREDDIPNVRLLEADGEIFASPEFGKSGLISLLSRADGYVEIPDYLRRH

SEQ ID NO: 15816 - protein, 230 aa, Zea mays
PRVRFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 15817 - protein, 568 aa, Bacillus cereus ATCC 14579
MSKFTVASNGALETTLRGAEVLSTPLLNKGVAFTQNEREELGLKGLLPPAVLTLEEQARRAYEQFSSQPDDLLKNVYLTALHDRNEVLFYRILTDHLREMLPIVYTPTVGVAIQRYSHEYRKPRGVYLSINDSSGIEEAFTNIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDVCTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENDVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAESVARVNLSDNDIKMAVQEAMWKPRVSPNKSGRKG

SEQ ID NO: 15818 - protein, 678 aa, Arabidopsis thaliana
MHGRPRNASKPEEEAASAAKAVQLRSLQSQFMTNHHDKIYTNEAIELSTKLLEINPEAYTAWNYRKLAVEDRLARIEPDPNLVSAILDEELRVVESALRQNFKSYGAWHHRKWVLSKGHSSVGNELRLLEKFQKLDSRNFHAWNYRRFVVELTNRSEQDELQYTDDMINNNFSNYSAWHNRSVLLSSLLAQNADGFMPNIKIPEEYDFVHSAIFTEPDDQSGWFYHLWLLDQTLNVETPLLTSSWPSHGSSIILSGAGCLSGSSSMFTTFCSESGSFPLILYFDQAVGGVSSSTVTIDSELKGNEGLVWEPIPNKNSQVSCVWVARLKYVSSDPCEYKVKIRVGNSPGIVSSRGYNFNAPYEFVFTAHVHDTVEDSQEGIVSWTDGFDIWDAKSKDLNSLVTLDRLNAEMDFKWRQEAIDSEVECFGILPDSKIGKLTLARLLMAREAMVSDDAVKGVHYEEILQLYNDLMALDSSHYQYYKDEHSKAFLHKVTSSSESLSRHLLRYRDMNNLVCLRLNNLSLSRIASVEKLLFVQMLDLSHNELHSTEGLEAMQLLSCLNLSHNRIRSFSALDSLRHVKQLKVLDVSHNHIGKHSVDTTRYLCSSPLSNSELGQDDVGKQNPGLVTKYWDAYCVLTDLNLKQLDIAGNEIAGEEFSSFVLQVVPKLVWLDGQKKLGN

SEQ ID NO: 15819 - protein, 298 aa, Triticum aestivum
ADYRHMDGSGVNTYTLVNRAGKAHYVKFHWKPTCGVKSLLEEEAVTVGGTNHSHATKDLTDSIAAGNYPEWTFYIQTIDPDYEERFDFDPLDVTKTWPEDVVPLQPVGRLVLNRNIDNFFSENEQLAFCPGLIVPGVYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 15820 - protein, 343 aa, Haemophilus influenzae Rd
MKDLDWNNLGFSYIKTDYRFIAHWKDGKWDEGKLTTDSTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFDSETEVGPVTRRLYDELTGIQFGDIEAPEGWIVKVE

SEQ ID NO: 15821 - protein, 584 aa, Xanthomonas axonopodis pv. citri str. 306
MRWFSSPGATRYGPVGALLLCVAICDAARAAAFFHSGFFMHSIDVVLAMLLAVAASGYLIRILPFSLPLPLVQIALGAVVSGVFDAGHELEPELFFLLFLPPLLFLDGWRIPKQGLFRDKAAILELALGLVIFTVIGAGFFIHWLIPAMPLAVAFALAAIISPTDPVAVSSIASKVPIPKRLMHILEGESLLNDASGLVCFQFAVAAVLTGTFSVAAASLTFLWVALAGLALGVATTFGLSRIQAWIWRHFGEEPGSAILVNLLTPFAAYLLAEAFHASGILAAVAAGVTMSYVEMAGNAPGNMRLQRSAVWDTVQFTFNGIIFVLLGEQLPGILDGAVRSVQEAGHLNPWWLAVYVATISASLMALRFVWVFLSLRWNIFKAQRRGEAHVSPPWRIVVAVSLAGVRGAITLAGVLTLPLMLEDGSPFPARQLAIFLAASVILVSLLVASVALPRLLRGLELPEEEDEQLKEDLAVKAASQAALEAVEKLRQRLVDGSKHAERYNAAANQVSQRYQRKLGAVDMAETDPEEAVAYEKALRQFRHAALVAERNELFKLARRREISDDLSRRLVRNLDLIESRKRA

SEQ ID NO: 15822 - protein, 316 aa, Oceanobacillus iheyensis HTE831
MKDIITLGEAMVVFNPASTGPMKFVNGFHKTIGGAELNLAIGCARLGLDTGYITRLGNDEFGKSIRNFVRGEGIDASEIDFIDHYPTSINFKEIMEDGSVRTFYYRDKSPTLSMTPDVLNESYFKNAKILHLTGIFPAIGEGALKVWKQAIHLAKKHGVKISFDPNIRLKMWSKEQARKVLLEILPDVDILLAGDEEMDIIIGKRDPVDIIETCKELGIPYVAIKQGENGSVGYSQGETMKAAPVKASKVVDTVGAGDGFNAGILYGYLHDWSLERTLTFGNTIGSMVVGITGDNEGLPYYEDVQERLGEIERIER

SEQ ID NO: 15823 - protein, 492 aa, Brassica napus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQPGDRYRSWAPDRQDRFVKRWVEILSEPRLTHEIRSIWISYWSQADRSLGQKLASRLNVRPSI

SEQ ID NO: 15824 - protein, 300 aa, Triticum aestivum
MLPSTFQDKMKEEEALKRKLKARMEYAKFLQEPAKEMAKEVKASYSGETKQTAGDLDEFLNKDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 15825 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCNDATQVYKELQEAIKSYPDAFHRVIGFDNIKQTQCVSFIAYKPPGSD

SEQ ID NO: 15826 - protein, 367 aa, Monascus purpureus
MAEPQIPTKQKAAIYDKPGTVSTKVVEIDVPEPGPGEVLVNLTHSGICHSDYGVMTNSWKLLPYPTQPGQIGGHEGVGKVVKFGPGANGTGLKIGDRVGIKWVSSACGNCHPCHAGADGICLNQKISGYYTPGTFQQYATGPANYVTPIPENLSSAEAAPLLCAGVTVYAALKRSKAQPGQWIVISGADGGLGHLAVQIASRGMGLRVIGIDHGSKAALVKESGAEHFVDITAFPKDDNGAAIAAHVKSLTTEKLGAHAVIVCTASNAAYAQAFLFLRFNGTLVCVGMPEHESQAIATAYPAAIVFNQATITGSAVGNRIEAIEVLDFAARGIIKSHVRMAKLEDLTDLFNEMAEGKLQGRVVLDLS

SEQ ID NO: 15827 - protein, 351 aa, Nostoc punctiforme
MDTPNFSHLNTGHVMELGMIGLGRMGANMAHRLTQAGHTVIGYTRQPQKAEVLVQEGAIARGVTSFVELIEALTPPRAVWLMLPAATVDATLHTLMPFLDADDIIIDGGNSHYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQIDAETAPLRNPEFYQYDFNLADIAEVWQRGSVISSWLLDLIAIALLKDPDLANFEGRVSDSGEGRWTLMAAIEEGVPVPVLSTALYTRFSSRGQSDFANKLISALRYEFGGHLEK

SEQ ID NO: 15828 - protein, 131 aa, Zea mays
  unsure (1)..(131): unsure at all Xaa locations
IRTRSAPNIGSSSRFCSNYSCYCIWNSNSALTVKNRGCFLXEDYXLIEKLDLVYRDRXPERDMHARRDEAEGVYLDTLDVSHLTCAXDFLRAPAIQTSVIGRLSTXSHEXGRPETLRDHTCSLLKVLPPRG

SEQ ID NO: 15829 - protein, 331 aa, Rhodobacter sphaeroides
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 15830 - protein, 458 aa, Glycine max
  unsure (1)..(458): unsure at all Xaa locations
MSITHSLTTPLSSSSSAFLAPSSFNCRGQVSLPVKSVSICKCVATPEAETAYKTGVNRNPNMGKLQAGYLFPEIARRRSAHLLKYPDAXSLALGIGDTTEPIPEVITDAMSKRSHALATIGGYSGYGAEQGEKPLRRALASTFYSDLGIEEDDIFVSDGAKCDISRLQIVFGSNVKMAVQDPSYPAYVDSSVIMGQTGLFQKNVEKFANIEYMRCNPENGFFPDLSSISRPDIIFFCSPNNPTGAVATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPEGLKAMRDVIGFYKENTNIIMETFDSLGFKVYGGKDAPYVWVHXPGRSSWDVFAEILEKTHVVTTPRRRFGPGGEGFIRVSAFGHRENVLEACRRFKQLYK

SEQ ID NO: 15831 - protein, 180 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDLGLARVTSETDSMTEYVVTRWYRPPELLLNSSDYTAAIDVWSVG

SEQ ID NO: 15832 - protein, 266 aa, Oryza sativa
  unsure (1)..(266): unsure at all Xaa locations
MSSHERFRLSHLMPNSWFYKLRDMKRPRPTSSRXDHRSRSCSKKLQEIVVVVKQHPPLLPPWTWNHHSQASPXSPPRRSYYPYLERAKQMPLMEKESQLISHSPLHQRIPATAIPGDHHDGEFQDLQLRPIRTRPPSAAAASAEPRRTASGSGTCPSSPRMRSRRLHVLGGCECRAGSGRRRSGGGGFAVVKASAEPARDFRESMVEMVVGNGMRSPEDLLELLECYLSLNAREHHGVIMEAFRGVWVEIVADADCCVGFWIDRID

SEQ ID NO: 15833 - protein, 238 aa, Oryza sativa
RAPHRLIDIPVSNCLNSNISKIYVLTQFNSASLNRVVSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDTVRAKEMPYIASMGIYVFSKDVMLKLLRQNFPAANDFGSEVIPGATEIGMRVQAYLYDGYCEDIVTIEA

SEQ ID NO: 15834 - protein, 1165 aa, Pichia pastoris
MPGITETSQVTGPVLAHVIVTEDPYDASERAFLSTDLYELLFEDYANGSKSGLTLISIQLMGSSLFNEFQTFKVYESEEQLPPNTVNLCNMGNIIDYSSDFTVDSGYVARVDSLVKLDTVIISVLPEVYSLASQSQHQLVDILGGNDQHTVIRQGDYNKDINGKISLCEPTDQGFLESTTKIIVVKENSLNLPLLDQSQDGSLNYEENVKMNLEHSISNYFSLNSLDPENQITTTGVEFSVKCLDSPISVRKTAKSISVAHDSEDESSPKLVEEDISNEDTLLYAFCKTTELAKIGCLSGDIVKMKSGQCQCTTFECNCESCPVQYRYIRIHAFTDPNTYEKGCIYLNPILSFNLNNPKIVKLCPISIPDKRFELQGFHFSKFIPLAKQVTIARVSSPVTLDRTLQTLFLTNLKTYFESGRKVLSKDQLIPIPVDTLLAKSIFSTYEKLGVDDSQFPTVIPEGKPDAIAWFKVTEVSGELADSASQQFIIDPLKTKMMQSGVVSCSPPKNSQHCNWANYLGCGQMFSFPNVSGVTTSTFEYAKTLRKLIKATIDPSRLVNLQTTVLLSSLSRAIGKSLLVHSLALECGVHLVEIDGYEVLNPSSESKTIGTIRGKLDRVVEGCTPLIVFIKHIEALTKKSEQQQKDSLAVKINELIDEYTAKPGVLFVASTNDSDNLSDELRAKFKFEIVLGVPSEQERTLIFKYLIDFDQKTTPKVTEGTRELSFAPRNDLSLSSLSLQSAGLTPRDLISIVENAKTLAVDRVESLAKHHNVSFENMVYSSGGYIKFTPEDVEKSINTARNKFSDSIGAPRIPNVKWEDVGGLDVVKDEILDTIDMPMKHPELFSNGIKKRSGILFYGPPGTGKTLLAKAIATNFALNFFSVKGPELLNMYIGESEANVRKVFQRARDAKPCVVFFDELDSVAPKRGNQGDSEGVMDRIVSQLLAELDGMSGGDGGDGVFVVGATNRPDLLDEALLRPGRFDKMLYLGVSDTHEKQSKIMEALSRKFHLHPSVDLDKVAESCPFTFTGADFYALCSDAMLNAMTRIANTVDEKIKRYNEELPEKSQVSTRWWFDNVATKEDIDVLVTLEDFDKSRKELVPSVSAEELDHYLRVRQNFEGGKEKKVVQENGQTEHFSNGSANNHITFGDEQVVEAIDENGNSIIA

SEQ ID NO: 15835 - protein, 203 aa, Schizosaccharomyces pombe
MNLICSILPKKEPSYLKLWRKQVIYQVLTDRFALDEDNFYAKASGNLYLGGTWKGITRNLDYIKSLGCTAIWISPIVKNISETTDCGQAYHGYWAQDMTQLNENFGTEEDLKELVNAIHEKNMLCMVDIVVNHMGHAGSKPVNFLLYQPFNSGKYYHNWQFVQNYDDPHETITGWLGDSHVNLPDIRTEKNEVRKFFQNWVSD

SEQ ID NO: 15836 - protein, 481 aa, Chondracanthus tenellus
GQGIKNERYESGVIPYAKMGYWDPDYVVKDTDVLALFRVSPQPGVDPVEASAAVAGESSTATWTVVWTDLLTACDLYRAKAYKVDSVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAAAGETKGHYLNVTAATMEEMYERAEFAKELGSIIVMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGPQILQDAAKTCGPLQTALDLWKDITFNYTSTDTADFVETPTANV

SEQ ID NO: 15837 - protein, 148 aa, Zea mays
MMMSAKKIAHLAKKWQRMAAQGRKRLTLGAAAAKEVDECCGSVASKGHCAVYTADGARFEVPLACLSTPVFRELLQMSQEEFGFAGGDGSRITLACDAAVMEYAMCLLRRGASAELEQAFLSTMAMSCHCAIYMAPYVGRARQQQIVV

SEQ ID NO: 15838 - protein, 236 aa, Oryza sativa
MAAAAAAKIAPSMLSSDFANLAAEADRMVRLGADWLHMDIMVTCAIPLLCRHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGEVISALRKSVEGSQNKS

SEQ ID NO: 15839 - protein, 461 aa, Escherichia coli CFT073
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 15840 - protein, 417 aa, Azospirillum brasilense
MERILGGMSLPDLGTFALVNERLERLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAEPVFLPSTRETGFLPDLDALTPELLERTALFYLCTPANPQGAAADAAYLERAIGLARRYGFILAVDECYAEIYLDKPPVGALQLASGLHHGGKPWTNILVFHSLSKRSSAAGLRSGFVAGDPELMSRFTRLRSYSNAGMPLPVLAASAALWRDEAHVEENRALYRAKFDAAEAALNGRYGYYRPDGGFFLWLEVGDGEEATRRLWAEGGIRVLPGAYLTRCNPGEANPGAPFIRIALVNDAETVAHACSTIARILG

SEQ ID NO: 15841 - protein, 313 aa, Zea mays
MPAHRDFLPARFAALLDSSCVPTGPRHAAAEALPAGSSDSSLGWLVGWVAGMSTAVARPAHGGFRRSGSGKPDPDEADRMMRSANAYLVQEEEEEEHGDEAAARREEEEEEAVSEASSIGAASSDSSSSIGENSASDKEEEEEVESKAQGLGMMGLATLESLDDALPSKRGLSSFYAGKSKSFTSLAEAAAAAAAREIAKPENPFNKRRRVLQAWSRRRASCSALAAAYLPPLLAPDHAVVEEDDDEEGADDEEEEEEHGGGGGLRGTRRPPTFPSPRLSVHVAAAGQMARNGSFRSPRSFSMTDLHSAAGYE

SEQ ID NO: 15842 - protein, 369 aa, Zymomonas mobilis
MTAAPELRPKSWIDSIAPYIPGSSKTLDGRPAVKLSSNENPLGTSLKAKEAYREAIDSLSLYPDSGATALREAIGACYNLDPARIIHGTGSDEILHLAAGAYAGQDDEVLYPRYSFSVYPLAARRVGATPVEAPDDDYRCSVDALLKAVTPRTRVVFIANPNNPTGTWITRAEVEKLHNGLPRNCLLVIDQAYAEYLDPECDDGALALAKNTKNVLVTRTFSKIYGLAAERIGWAYACPEIIDALNRIRAPFNVTIAGQKAAVAALEDQAFIQNSFKHSKKVAWLVENQMALLSNVGIRVIPSSANFTLLLFEGSLTAKTAYKALMDHGYTTRWLPGQRLPHALRITIGSEKHMQDVAGILTSLVRQAL

SEQ ID NO: 15843 - protein, 140 aa, Hordeum vulgare
VTEPPCEVKDRCASKLLVLAPGRAALTTPAPNLNSGIDPLSASPSSLGQGEVNAAASSQSNASLSQMDERELKRERRKQSNRESARRSRLRKQQECEELAQKVSELTAANGTLRSELDQLKEDCKTMEVENKQLMGKILG

SEQ ID NO: 15844 - protein, 488 aa, Vaucheria prona
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKLGTIIVMIDLVVGYTAIQSMAIWARKADMILHLHRAGNSTYARQKNHGINFRVICKWMRMAGVDHIHAGTVVGKLEGDPLMVKGFYNTLLDTKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 15845 - protein, 638 aa, Agrobacterium tumefaciens str. C58
MKKLDLITIGRSSVDLYGSQVGGRLEDMASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKAGIRNKALRKDEALEQVHWSTNRKGDWDTMRVFAFDHRMQLEAIADELGVKHEQIGAFKKLCLQAAQKVSGGEAGYGILCDGRLGRDALFAASGSGLWIGRPVEWPGSRPLTLEPDLGKDFGGLSEWPLENVVKVLCFYHPDDTDEMRAAQEETVIRLFEAARRNRLEMLLEVIPSKVGPTDDLTAARIIERFYEIGVYPDWWKLEPMKTTAAWKNACDAVHRNDPYVRGIVVLGLDAPQSELEESFRLAAGFDLVKGFAVGRTIFADAARGWLGGKITDEEAVKDMAQRYTSLCRIWDEARAKKGEAA

SEQ ID NO: 15846 - protein, 304 aa, Photobacterium profundum
MNKKHLPLLLFCSVCFIWGTTWLAMEVAVDTIPPIFATGLRFLIASPILVLLSKIFNQPLLFPKGKNKWIAIVAVFYFAIPFTLMIAGEMYISSGLASIIFANMPIAVMITSTLFLGLRLAIHQFIGLFIAVISLFIILSNELGIGGDNLLIGSGALGLAVAIHAVMYVMVQKHCKDIQVITYNALPSFVAAILLFITSLAFENINVQAFSSSSLMAVGYLGTFASVGGIVAYFKLGQISTPFTASICFLIFPLVALALSAATSGAAISEQSILMLLPLLSGILLTKVPLSKFKAARKLVTSSQ

SEQ ID NO: 15847 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 15848 - protein, 880 aa, Saccharomycopsis fibuligera
MLLILELLVLIIGLGVALPVQTHNLTDNQGFDEESSQWISPHYYPTPQGGRLQGVWQDAYTKAKALVSQMTIVEKVNLTTGTGWQLGPCVGNTGSVPRFGIPNLCLQDGPLGVRLTDFSTGYPSGMATGATFNKDLFLQRGQALGHEFNSKGVHIALGPAVGPLGVKARGGRNFEAFGSDPYLQGIAAAATIKGLQENNVMACVKHFIGNEQDIYRQPSNSKVDPEYDPATKESISANIPDRAMHELYLWPFADSIRAGVGSVMCSYNRVNNTYSCENSYMINHLLKEELGFQGFVVSDWAAQMSGAYSAISGLDMSMPGELLGGWNTGKSYWGQNLTKAVYNETVPIERLDDMATRILAALYATNSFPTKDRLPNFSSFTTKEYGNEFFVDKTSPVVKVNHFVDPSNDFTEDTALKVAEESIVLLKNEKNTLPISPNKVRKLLLSGIAAGPDPKGYECSDQSCVDGALFEGWGSGSVGYPKYQVTPFEEISANARKNKMQFDYIRESFDLTQVSTVASDAHMSIVVVSAVSGEGYLIIDGNRGDKNNVTLWHNSDNLIKAVAENCANTVVVITSTGQVDVESFADHPNVTAIVWAGPLGDRSGTAIANILFGNANPSGHLPFTVAKSNDDYIPIVTYNPPNGEPEDNTLAEHDLLVDYRYFEEKNIEPRYAFGYGLSYNEYKVSNAKVSAAKKVDEELPQPKLYLAEYSYNKTEEINNPEDAFFPSNARRIQEFLYPYLDSNVTLKDGNYEYPDGYSTEQRTTPIQPGGGLGGNDALWEVAYKVEVDVQNLGNSTDKFVPQLYLKHPEDGKFETPVQLRGFEKVELSPGEKKTVEFELLRRDLSVWDTTRQSWIVESGTYEALIGVAVNDIKTSVLFTI

SEQ ID NO: 15849 - protein, 521 aa, Oryza sativa
MALPFPVPRGAHWAVTSTAHVLVGFTGEMARVEQPRAPAPYNAAFLRKKLTLATKMHTTKSSDSHLDIAGTVVTHSHGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 15850 - protein, 306 aa, Pseudomonas putida KT2440
MPASRRFPLLLIGAFLALYLVWGSTYLFIRIGVESWPPMLMAGVRFLIAGGLLYGFLRWRGVPAPTWPQWRAAGAIGFLLLSCGNGGVTVAEHAGVASGVAALAVATVPLFTLLFGLLFGHRNSKLEWAGIALGLVGIGLLNLGSNLQASPIGAALIIFAAASWAFGSVWSKTLPLPQGPMASAAEMLVGGAVLLLGSVLSGERMTQLPTAAGWGALAYLVFFGSILAFSAYMYLLKHVRPAAATSYAYVNPAVAVLLGIVFAGEQIGAEECVAMAVIIGAVVLIGLPQWRKAPEPVQPLKGEICK

SEQ ID NO: 15851 - protein, 210 aa, Oryza sativa
  unsure (1)..(210): unsure at all Xaa locations
CLAPFVVSQLRPEIQVAAQNCWAKKGGAFTGEVSAEMLVNLSIPWVILGHSERRSLLGESNEFVGDKVAYALSQGLKVIACVGETLXQREIGSTXMDGGAAPTKSNWLKGSKDWTYVXVVALEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 15852 - protein, 164 aa, Lycopersicon esculentum
SNVVVGLNDTMENLLAAVDRYEAEISPSTLHAIACIMENVPFINGSPQNTFVPGLIDLAIKRNTLIGGDDFKSGQTKMKSVLVDFLVGAGIKPTSIVSYNHLGNNDGMSLSAPQTFRSKEISKSNVVDDMVASNAILYESGEHPDHVVVIKYVPYVGDSKRAMD

SEQ ID NO: 15853 - protein, 751 aa, ASPERGILLUS NIDULANS FGSC A4
MLSHYTGYKPGDVPGNLPDPYYWWEAGAMFNALIDYWFYTGDSRWNNITSQALIWQAGESGSFMPANQTRTEGNDDQGFWAFAAMSAAERNFPMPRDKHETPGPDWLAMAQATFNTQAWRWDAQNCGGGLRWQIFTWNAGYMYKNTISNGCFFNLAARLARYTGNQTYADWATKVWNWTHAVGFMTDDYSFYDGASIDGNCTNFDHVQWTYNAGVYLLGAAAMYNYTNGDPLWKQRTEGIINAAHIFFADSPSSKDIMYERACESINTCKVDQRAFKGFLARWMAQSTQFAPFTYDMVMPKLRSSALAAAKTCTGGSDGAECSLKWTEQKYTGGPAGGDVGIQMAALEVLQSTLIQKVEPPVTRKEGGLSMGDPAGGSEPPVPTPALLVREIETGDRFSRTRQGSMGSITPLEIPTHCKAGVIYNPGPNFTVKVEDVPVPQPGADDILIRLNVTGLCQSDLHYMLDDLGISMSTFGVRSPGHEGAGVVVKVGENVKNFKVGDRAGIKPMMDTCGACTSCWSDKETYCAGAVHTGLMYVVSPARYATPIPEGIPDEIAAPIMCKSRLQAGDWAVFPGGGSQGGVGIQGVQLASAMGMRPIVVDTGEEKKNLALKMGAEAFIDFKTVPDAAAAVVEIADGIGGHGVFVTAQAAYPTALAYLGTRIGGDLMCIGIAPAGTMSIPVDPNLLLFRNTRIQGTLVGSRHDTIKALDFARRGKLKQICEVWPVERLPEAVDRLRKGLVAGRMVVDFNQ

SEQ ID NO: 15854 - protein, 583 aa, Schizosaccharomyces pombe
MSSPDRSIDIDLEKYPSTATKSVYGQSKDDKNVFDIHPTESEVIPGEVEYADTPSHQNFLQKFFSDFKPVKADREDGVALKRHLKGRHMQMIAIGGAIGTGLFVGSGSSLADGGPASVIIDYTLIGIMMFFTVYALGELAVSYPVAGGFYNYAVRFIDPAWGFAVGWNYFMNYFVTFPLELTTCAITFRYWTDINSCAWITIFLVFVICINLFGVRGYGEVEFILSTLKVVATTGFIILAIIINCGGVPTDPRGYIGGKIIKNKPFRHSFKGFCSVFTTAGFSFSGTEVVGLAAAEAEDPQKSLPRATKQVFWRIAIFYVVSLILIGLLVSPDDPRLMGNSSDGSTSPFVLAIKEANIRGLPSVFNAVIIISTVSVANSCTFTASRTLHAMAAKGDAPRFFAYTDRLGRPLLAMAVCLLFGFFAYINAAGDVSDTVFDWLLAISGISNFFSWGSINLCHIVFRLAMKKQGRSLDQLGFVSPMGIWGSAIGLAFNILCLMAEFYVSLFPIGSKPNANDFFQGYLAAPIVIAFFIGYKIYDRSHIPSLSKLDLDTGLRTYPPKDKESEKIRDAKGFFKWIWQSLC

SEQ ID NO: 15855 - protein, 407 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNVLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 15856 - protein, 375 aa, Zea mays; identical to SEQ ID NO: 8072

SEQ ID NO: 15857 - protein, 151 aa, Glycine max
MLMNSASGGDAPSRGFDTPTLDLVSTALLHAIFEHGGYTCVSMATLAENGDIRTAEAVCKRAWEQLHSVLSVWREAYSMACLLVARHHYHNGEFKDVLRVLDLGIIMGGTLLRKDLDSAIEKISEQTRKSVRVSDLGNSDGYAQKLNTRVP

SEQ ID NO: 15858 - protein, 76 aa, Triticum aestivum
HMQQLRGSCFSIGASKMNNECTSFRNSCGEENAEGCRRTFQKVKREHAILRQKLESYFQLLRQAGPARTATRPGSM

SEQ ID NO: 15859 - protein, 198 aa, Glycine max
  unsure (1)..(198): unsure at all Xaa locations
RVSYVPPIRNSKKDPVVXWLTGGPGCSSEXAVFYENGPFKIANNMSLVWNEYGWDKVSNLLXXVDQPTGTGFSYSTDKRDIRHDEEAFAARVHRGNKAKEXIHINLKGFGXGXGLTDPGIQYKAYTDYALDMGIIQKADYERINKVMVPACEMAIKLCGTDGKIACTASYXVCNTIFNSIMSHAGDINYYDIRKKCEG

SEQ ID NO: 15860 - protein, 582 aa, Oryza sativa (japonica cultivar-group)
  unsure (1)..(582): unsure at all Xaa locations
MAPRIRVLAALDQARTQYYHFKAIVIAGMGLFTDSYDLFCISPVMKIFGRVYYAPSGSVDGSGSGPGVTPPAVVSATVGVALLGAVAGNVVFGALGDRVGRRRVYGACLLLMVCSSVGSGLSVCRXRRCALASLCFFRFLLGVGVGGDYPLSATIMSEFANRGTRGAFIAAVFSMQGFGILVSSAVTMAVAAAFDHYTGYPAPLDTPECADLAWRIILMAGAVPAALTYYWRMSMPETARYTALVERDVVKATNDIGRVLADLDLAAVAEEEVAAAALSPPPVTTPPPPRPSYGLFSRRFVRQHGRDLFACAAAWFLLDIPYYSSTLFQSQIYRPWFPPAAKVNAFQEAFNVAKFQAVIAVASTIPGYFAAMLLIERAGRRRLQMAGFLLMAVFLFALAGPYDGYWRDHAKTAGYIVLYSLTFFSANLGPNTTTFILPAELFPARFRSTCHGLSGAAGKLGALVGSIGFLWASQQKDGAAAGHLPGIGMMYALFVLGGICLLGLALTYAFTPETMTRSLEENESSVQAQSQVGDGGSDAGNGSDGLRFHELNVLMEAATKSPVSMASSHLSMSPILPHRMSL

SEQ ID NO: 15861 - protein, 454 aa, Methanosarcina mazei Goe1
MKIKSIDPYTEEVNWTYDALSFGDCEDQIEKSRAAFLKWGSLSVKERTAYISRVAEILRQNRRIYAGIITKEMGKPVRQSLAEIEKCAWLCDYYAENAAGFLEDELVETEAEKSYVTFEPLGVILGIMPWNFPFWQTFRFAVPTLIAGNVCLLKHASNVPGSALEIEKVFTGAGLPQDVFKSLLIDSRTAMEIIDEDLVDGISLTGSVRAGSEIGELAGRTIKPFVLELGGSDPFIVLEDADIDRAAEVGVRARFINTGQSCIAAKRFIVVEDVVVDFIEAFELHMQELKVGDPMDEETDIGPVAKKEFIDSLERVLKDAKKKGAEPRVYGEEHKKGFFFRPTIVPAASTDMKVLNMEVFGPIAPVVMVKDEDEAVKIANSTDFGLGAEIWSADLKRAEHLAKRIKSGFVTINGRVKSDPRLPFGGVKKSGIGRELSHYGLKEFVNIKTVVINK

SEQ ID NO: 15862 - protein, 523 aa, Triticum aestivum
MALEAAQHYLQLAVGHGMSSPAALLLVVVPLLLLLLASVRTSASTRKLRLPPSPPGSLPIIGHLHHIGVQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVCLVVNKIHEAATNAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKRLDMITEEDLSSLPYLKATMKEALRLHPPGPLLLPHYSTADCNIDGYDIPAKTRILVNGWAIGRDPKAWERPEDFMPERFLQDGQEKSSNLGQDFKYLPFGSGRRICPGANFALATMEIMLVNLMYHFDWEVPNEREGTGGKVSMAETFGLMLRRNEKLYLVPKIV

SEQ ID NO: 15863 - protein, 259 aa, Zea mays
  unsure (1)..(259): unsure at all Xaa locations
GTPVTLRTSTGYQYNCNTGLEIGGEANLTAAIQVAQFALKNRQNKQLRQRIIVFVGSPVIDEKNWLEVIGKNLKKXNVALDVVNFGESDNEKPEKLEALVAAVNSGGNSHIIHIPAGRDLSDALFSSPIILSEDRGSDSAAAARGASGFEFDVDPNVDPELALVLLISMEEERLRQEAAAKKAREESSKTENEGQSSTSNGDIVMADAEPEPNSYTEDKGLHCKVCFIAIQLMQSVSFVLDVQQLLEITHKKGLLRPPQ

SEQ ID NO: 15864 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 15865 - protein, 263 aa, GIBBERELLA ZEAE PH-1
MTSNTQPYSVRNRRPSATENLIDAAKNIESKVEHSLLLLWDDLPAWRRDNGFILSGYRQSQNSYAHSFRSLFYLHNESVNIWSHLIGAIVFLGSAAYVDRVVRPRYASASSADVLVFACFFGGAVVCLGMSATFHTLSNHSDTVAKWGNKLDYTGIVALIVGSYVPALYYGFFCLPNLMTAYLWVICVLGVGCTFASWVERFRTPTWRPYRTMMFVGLGLSGVVPVIHGAFIYGFQGLEDRMSLSWVVLHGAIMFTPASYFIC

SEQ ID NO: 15866 - protein, 203 aa, Triticum aestivum
  unsure (1)..(203): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEEXKKEYPDAYVRIIGFXNMRQVXCVSSIASTGLPGSGLNTNHTGIKMHSVNPNCLFLHYLLMSKKWPV

SEQ ID NO: 15867 - protein, 252 aa, Bacteroides thetaiotaomicron VPI-5482
MRKNIVAGNWKMNKTLQEGIALAKELNEALANEKPNCDVIICTPFIHLASVTPLVDAAKIGVGAENCADKASGAYTGEVSAEMVASTGAKYVILGHSERRAYYGETVAILEEKVKLALANGLTPIFCIGEVLEEREANKQNEVVAAQMESVFSLSAEDFSKIILAYEPVWAIGTGKTASPEQAQEIHAFIRSIVADKYGKEIADNTSILYGGSCKPSNAKELFSNPDVDGGLIGGAALKVSDFKGIIDAFNA

SEQ ID NO: 15868 - protein, 278 aa, Triticum aestivum
  unsure (1)..(278): unsure at all Xaa locations
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGEFDGHSKRVLSCXSSQRDFKPTRPFRIVTCGEDFLANYYDAPPXLRHPSHLGXASGVHRIRPSPARTKFITVSSDKKGLIYDGKTGDKIGELSSEGSHTGSIYEADRARAPARSLPFRIDLGLEGFGDKACAIFFIIES

SEQ ID NO: 15869 - protein, 222 aa, Vibrio parahaemolyticus RIMD 2210633
MNSPMFTRSTSVPNTLETNKVLKNTYFLLSMTLMTSAIAAVATMAMQISPIMAIVMQLAAIGILFFVMPKAINSSSGIVWTFVFTTLMGGALGPMLNYYASIPNGPTIIAQALGLTGMVFLGLSAYTISSKKDFSFMRNFLMAGLIIVIVAALINIFVGSTMAHLVISSVSALVFSGFILFDTSRIVRGEETNYISATISMYLNILNLFTSLLSILGIMNDD

SEQ ID NO: 15870 - protein, 541 aa, Coxiella burnetii RSA 493
MRRLFQLIRLIQINFILLRHGFNRPVIGELSPSLRLLSYLNPWSFIQKDKSRGESFRIVLEELGPIFVKFGQLLSTRRDLLPDDIAEELEKLQDRVPPFPGKIAKAMIEKSCGKTIEDCFATFDETPLASASIAQVHAATLHDSSEVIIKVLRPNIAKTIQRDIALMYLGAKLARRFWRHGKRLKPVEVVAEFEHTIYHELDLMREAANASQLRRNFADSEKMYVPKIYWDYVHRDVMVMERIYGIRISNIAELKAANTNLKKLAEYGVEIFFTQVLRDSFFHADMHPGNLFVDVTDPENPKYLGVDFGIMGALSPQDQRYIAENLLAFFKRDYRQVAILHIESGWISADSRIDQFEAAIRTVCEPIFERPLKDISFGKLLLRLFQTADQFNMEIQPQLLLLQKTLLNIEGLGRQLYPDLDLWRTAKPFIEDWMRKQHGPRYLLNTAIKEFPLAVKTTLKLPRLLHDVLHEIHFRQNLERNEPRPPRKKQKRGFILGAGLAFLISALVSFLIAPTSPSPWQWTALGGGILLIIIGWLTPKD

SEQ ID NO: 15871 - protein, 355 aa, Glomerella cingulata
MSRANPPNASGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 15872 - protein, 511 aa, Streptomyces lavendulae
MKAMDRVDRAVERFPMYIDGQAVQAHDGAVLRTFEPATRRHLADLPSGGAEDVRRAVSAARRAFDEGPWPRMAPGERAGLLRKAAQRLREEAEPLAELEARDNGSTLRKALGADVPGAAAAFEWSAWWAEHVPERQPEAPGSGSYVVWRPVGVVAAIVPWNLPLLLAAWRIAPAIAAGNTCVIKPASFASLSTLRLVELLHECGLPPGVVNVVTGPGGVAGEQLVRSPGVDLVAFTGSDETGAAVREGAAAAGTSARLDLGGKSPNIVLADADLDRAVTGVTWGAFLHNGQVCMAGTRAVVHADVHDDFLRLLSERVGRLRVGDPLDPATDLGPLVSRNQARTARRFTELGLSQGAELVCGGRAPAADELPPGLDAGAYFLPTVLASVGADDAVAQEEIFGPVLAVVRAGSDDDAVRIANGSRYRLSAGVWSADPARARAVAERLRADRVWINDYRLVDLELPGTAGPRSAVWDRLTNELDAYRHKHVVHGGGAGAGGVPAPPTPYALLGG

SEQ ID NO: 15873 - protein, 494 aa, Xylella fastidiosa Ann-1
MSYPCGFLHSSRLVMSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTVNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRVLSTVNERTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 15874 - protein, 966 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIVWVLSFLAHGYATEEFEVTEERLGVYRPEEHIDNPLGYADGKDAREFDPRLRGPVHPGELEIDLYSGMKNYIANERLAYQQGWNTTSAGYIRFSLERCIHFGRLYTSGSRGRGKESDLCEALRCLGQALHTLEDFPAHSNYCELVLIDMEERRGGHSPVFPHVGTDTRITLRNDTRNNGKSVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLGPFLRPIINQVTQVLKEGSSGLIATSAKQQLEPWNNPQCDNPTHSMLSKDHFTNILNSCAGRVAANIVQYVVPRVVYAWENPGVPDSEVIADVLQVFHHPANYKEEVEIQRTMYETVVQWSRETHHDYKTLLASESVKEGHNHVLNGQPMDRGPGGGHTSCGADGGHGKVAGSLWSKIQSRDLDTSAPSGGVGGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSSQPSYGAPPSQPPYGSQPHYGGPPHSSYSGGRPPSPPRPSGYGGGYAGYSAGPPPSHGGYGGSPHGGAPYPHGGAVGGGGSAPYPHGGRADAYERNYDQHYERDERRGGRDGRRRRGSHGSRSSSEERIGRGFPGQGSRGSGHHGGGGGYGGGYGGGYGGGYGGGYGGGGGYGGSYGGRDEHRRY

SEQ ID NO: 15875 - protein, 815 aa, Escherichia coli K12
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 15876 - protein, 92 aa, Oryza sativa
WYHILKSQTHGVLTDTCKHTKPQHQGIPKGCMAVRVGGGAEGERFVVPVGYLKHPLFVGLLKEAEEEFGFEQKGAITIPSGVDHFRRVQGII

SEQ ID NO: 15877 - protein, 658 aa, Zymomonas mobilis
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 15878 - protein, 380 aa, Triticum aestivum
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 15879 - protein, 234 aa, Zea mays
  unsure (1)..(234): unsure at all Xaa locations
VYQQSIGAVCNLDWPRSNFLVQVLDDSDDAATSALIREEVEKWQREGVRILYRHRVIRDGYKAGNLKSAMNCSYVKDYEFVVIFDADFQPQEDFLKLTVPHFKGKEDVGLVQARWSFVNKDENLLTRLQNINLCFHFEVEQQVNGAFLNFFGFNGTAGVWRIKALEDSGGWMERTTVEDMDIAVRAHLKGWKFLYLNDVECQCELPESYEAYRKQQHRWHSGPMQXFRLCFVDI

SEQ ID NO: 15880 - protein, 229 aa, Eleusine coracana
LENKISRQVTFAKRRNGLLKKAYELSLLCDAEVALIIFSAGRGRLFEFSSSSCMYKTLERYRTCNFNSHEVKAPLDSKINYQDYLKLKTRVEFLQTTQRNILGEDLGPLSNKELEQLEKQIEISLTQIRSRKNQMLLVQLLDLKSKEQELQDLNKDLRKKCQLKKTCGENATHISWEEGGHSGTSRNANEPNQGFLQHAENNYSSLQIGYYQQAYMDQLNNQDIGAAHN

SEQ ID NO: 15881 - protein, 327 aa, x Doritaenopsis sp.
MESGSFPVINMELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 15882 - protein, 252 aa, Synechococcus sp. PCC 7942
MHSVGGWAALIGAITLGPRMGKFQDGRPGALPGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSPEEELQGLDIGEHGMEAYSGFAKDASNALSSISE

SEQ ID NO: 15883 - protein, 342 aa, Thermosynechococcus elongatus BP-1
MVQERSLPSLSIPQTAITREQGLMLYEDMVLGRTFEDKCAEMYYRGRMFGFVHLYNGQEAVSTGVIKAMRPDDYVCSTYRDHVHALSAGIPAREVMAELFGKATGCSKGRGGSMHLFSAKHNFLGGFAFVAEGIPVATGAAFQTLYRRQVMGDAKADQVTACFFGDGASNNGQFFECLNMAALWKLPILFVVENNKWAIGMAHERASSETEIYKKAKVFGMVGEEVDGMDVLAVRTVAEAAIARARAGEGPTLIEALTYRFRGHSLADPDELRSKEEKEFWLKRDPIKKLGAYLVEQELATGEDLRAIEQKVQAIVEDAVTFAEQSPEPKPEELYDYIFADE

SEQ ID NO: 15884 - protein, 367 aa, Cucumis melo
MPNLTPFSKLDKTFDRASELKAFDQTKAGVKGLVDSGVAEIPGIFYCPPKEASNSIPEETHLGVPVVDLGDIDKDPFKRRQVVEEIREASETGGFFQVINHGVPVSVQEEIINRVRRFFEQDSEVKKQYYTRDYTKSFIYNCNFDLFSSPVANWRDTIVTVMAPNPPNPHDLPQVCRDILFEYSKHIMKLGELIFGLLSEALGLKSTHLVDLDCNEGLRIIGHYYPSSPQPELSIGTTEHSDDTFITVLLQDNMGGLQVRQQNKWVDVPPVPGAFVINVGNLLQLITNDRFVSSEHKVLANREGPRISVASFFSTGRLPTSKLYGPIKELLSEQNPPKYKEITVREYNIYFAEKGLDGTSALPHFKI

SEQ ID NO: 15885 - protein, 458 aa, Marchantia paleacea
MPKRSNGSLVVRCAVSVVRFSKENVSCDLASENFTFSRDSFPVVSTVLRVSEAVYRMAAVASLGSALSVSSAALSQNVSVSNNATKESAFLGLRMGEVAKFGGALLSVSTVAANLKSKPGVLSVNAVTAPAETMNKPSSKKTATKSTCIITGASSGLGLATAKALADTGEWHVIMACRDFLKAERAARSVGIPKDSYTVIHCDLASFDSVRAFVDNFRRTERQLDVLVCNAAVYFPTDKEPKFSAEGFELSVGTNHMGHFLLARLLMEDLQKAKDSLKRMIIVGSITGNSNTVAGNVPPKANLGHLRGLAGGLNGVNSSSMIDGGEFDGAKAYKDSKVCNMFTMQEFHRRYHAETGITFSSLYPGCIAETGLFRNHVTLFRTLFPPFQKYITKGYVSEEEAGKRMAQVVSDPKLSKSGVYWSWNKDSGSFENELSEEASNPEKAKRLWELSERLSGLV

SEQ ID NO: 15886 - protein, 228 aa, Chlamydia muridarum
MKKQGVLIAPSIMGADLACLGDAARNIEESGANLIHIDVMDGHFVPNITFGPGIIAAINRSTDLFLEVHAMIYTPFEFVEAFVKAGADRIIVHFEAAENLKEILDYIRKCGVQAGIAFSPETSIEFISAFIPLCDVILLMSVQPGFCGQKFIPDTIEKIRFVRQAIQTLGKEGSCLIEVDGGIDEESARACREAGADILVAASYFFKKDSINMKEKVLLLQGEEHGAK

SEQ ID NO: 15887 - protein, 486 aa, Bifidobacterium longum DJO10A
MDLFRKKSVDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIVCAVWYVKPSNWQPFSPYGVYTFQPGSTQPYGIVPAASIVFFSFIGFDAVSSSAEETINPNKTLPRGILLSLAVSTVLYVIMTLIMTGVVPYKEFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAVWFGLGLIVYFGYSRKRSKLGLEQKAGADAKVAATED

SEQ ID NO: 15888 - protein, 420 aa, Saccharomycetales
  unsure (1)..(420): unsure at all Xaa locations
KIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTXAXKDVYNFLELFFDXFPEYVNKGQDFHIAGESYAHGYIPVFAXEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDELNQDYVKEAVGAEVDHYESCNFDINRNFLFAGDWMKPYHTAVTDLLNQDLPILVYAGDKDFINNTLGNKAWTDVLPWKYDEEFASQKVRCWTASITDEVAGEVKSYKHFTYLRVFNGGHMVPFDVPENALSMVNEWIHGDFSL

SEQ ID NO: 15889 - protein, 382 aa, Xylella fastidiosa Temecula1
MQVTSKLPQVGTTIFSVMSQLADVYGAVNLGQGFPDFPVPLRLQEALAGAVREGHNQYPPMIGVAGLRQGIAAKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPSALSAEFRKVHQYNTFTSFGPAQYAFAAMLHEEPGYVEQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 15890 - protein, 429 aa, Nostoc sp. PCC 7120
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 15891 - protein, 340 aa, Glycine max
  unsure (1)..(340): unsure at all Xaa locations
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGFXMPPVHSITATQKTVDGPSAKDWRXGGKAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKFF

SEQ ID NO: 15892 - protein, 385 aa, Carica papaya
MSFLDPYPSTLTPRRSPSSSTVRFRNSQLSISAVAASPLSLKQQTTHSMPPEKMAVFESLEDWATHHVLPLLKPVEQCWQPASFLPDPTQNKADFHDQVRALRERTAQLPDDYFVVLVGDMITEDDLPTYQTIINTLDGVRTRLGRSPTPGQCGLGPGPRKKNRHGDLLRTYLYLSGRVDMLMIERTIQYLIGAGMEPRKQRNNPDLGSVNRHFQNEPTFDPMATGSLAKQAGDPVLAAHIRGPSASYETTRERYPLRIVEELLEVDPTGPMMAISSMMEKKITMPAHLMYDGKEPRLFEHFSAVAQRLGVYAADDYADILEFLVGRWGLEKLEGLTGEGRRARDFVCGLAPRIRKLQERADERAKKMEPHYAKFSWIFNKEVLL

SEQ ID NO: 15893 - protein, 370 aa, Rhodospirillum rubrum
MPVSKKILFLAGDGIGPEVMAQVRRVMDWLNQTGRTAFEVEDALVGGAAYDAQGTPLHDDTVALALAADAVLLGAVGGPKWDASLPFELKPERGLLRLRKDLELFANLRPAMVFDALAEASTLKTELVSGLDVMIVRELTGGVYFGQPRGISALPNGERRGVNTQVYDTHEIVRVAKVAFDLAGKRGKRLCSVEKANVMESGLLWREEVTKLGADYPEIALSHMYADNCAMQLVRQPKQFDVIVTDNLFGDILSDCAAMLTGSLGMLPSASLGAADAAGNRRAMYEPVHGSAPDIAGQDKANPLATILSFSMMLRYSFDLAEEADLVDNAVRGVLAKGLRTGDIFQPGKTLVGTTGMGDALLAEMAQLAN

SEQ ID NO: 15894 - protein, 513 aa, Eremothecium gossypii
MLATAQVRTLRALVRCYSSLPLTVQVRLPNGNSYEQPTGLFIDGKFVPSHQAKTFEVIDPGTEEEITHVYEAREEDVDAAVAAAKRAFLPWSRADPEVRAQCLFKLADLIEKHQETLANIESLDNGKSLLCSRGDVALVARYLRTCGGWADKIYGNVMETGPDHFSYTRREPLGVCGQIIPWNFPLLMWSWKIGPALATGNTVVLKPAESTPLSALYVCNLANEAGIPKGVMNIVPGFGKIVGEHLCTHPDVKKVAFTGSTATGRHIMRTCAETVKKVTLELGGKSPNIVFADADIDKAVKNIGFGIFYNAGEVCCAGSRVYVQDSVYDEVLEKFKQFSENLKVGNPFEEGVFQGAQTSQMQVDKILSYVDIGVKEGARIVAGGERLGRKGFFIKPTIFADVNENMRVVKDEIFGPVVTVSKFSTVDEVIAMANNSQYGLAAGIHTTDINKAIDVSNQIKAGTVWVNTYNDFHPNVPFGGFGQSGIGSEMGVQALDNYTQTKAVRMAIDHVKV

SEQ ID NO: 15895 - protein, 197 aa, Zea mays
MLAQRVGVNALRSGAAKPFFAQNISKSALAAGISTSSPTRATGSVKVSQEDGHQILVNQRLNRPVSPHLAIYKLEQTWFGSSAWNRITGCTLSATLYGFSIAYLAAPVVGLHPESLSIASFVAGLPLAVKGGLKFTLGFPFVYHTISGVKHLLYDAGKGFAKSTIIQADKYVWAASVLGAIGSGCFPVRYISNRRAE

SEQ ID NO: 15896 - protein, 444 aa, Brassica napus
MATITVVKARQIFDSRGNPTVEVDVHTSSGVKVTAAVPSGASTGIYEALGLRDGGSDYLGKGASKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGLHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNSKEENNNGSQKISGDALKGLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 15897 - protein, 225 aa, Zea mays
MAAAKIAPSMLSSDFANLASEAERMVRLGADWLHMDIMDGHFVPNLTIGAPVIQSLRKHTKAYLDCHLMVTKPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 15898 - protein, 299 aa, Streptococcus pneumoniae TIGR4
MTSKVRKAVIPAAGLGTRFLPATKALAKEMLPIVDKPTIQFIVEEALKSGIEDILVVTGKSKRSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFKGARYDVGDKFGFMKTSIDYALKHPQVKDDLKNYLIQLGKELTEKE

SEQ ID NO: 15899 - protein, 280 aa, Fagus sylvatica
DACENWGFFELVNHGLPHELLDTVERLTKEHYKKCMEQRFKELVTAKGLEGVQTEVNDLDWESTFHVRHLPQSNISEIPDLEDEFRKVMKEFALKLEKLAEELLDLLCENLGLEKGYLKKAFHGSKGPNFSTKVSNYLPCPKPDLNKGLRAHTDAGGIILLFQDDKVSGLQLLKDGQWIDVPPMRHSIVINLGDQLEVITNGKYKSVLHRVIAQTNGNRMSIASFYNPGGDAVIYPATALVEKEAEEKNNVYPKFVFEDYMKLYAGLKFQAKEPRFEAMK

SEQ ID NO: 15900 - protein, 235 aa, Zea mays; identical to SEQ ID NO: 6140

SEQ ID NO: 15901 - protein, 470 aa, Nitophyllum sp.1
GVIPYAKMGYWDPNYVIKETDILALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMENMYERAEFAKQLGTVIIMIDLVIGYTAIQTMGIWARKNDMILHLHRAGNSTYSRQKIHGMNFRVICKWMRMAGVDHIHAGTVVGKLEGDPKMIKGFYDTLLEPYLDINLPEGIFFQQDWASLRKVTPVASGGIHCGQMHQLLDYLGNDVVLQFGGGTIGHPDGIQAGATANRVALEAMVIARNEGRNYVAEGPQILRDAAKTCGPLQTALDLWKDITFNYTSTDTADFVETPTANV

SEQ ID NO: 15902 - protein, 458 aa, Synechococcus sp. PCC 7942
MPLNSPLDATVTPSPVALSSAPEIDYYQYTAGRRRKAAVVLVAVWGLTAALHLSLWGAPIVWAIALGLGIHFLRLMGAHRHAEVVALPSDRQDWPQVSLLVAAKNEAEVIERLVHNLCSLDYPSDRLEVWVIDDASTDATPDRLAELQSHYPQLRVHQRQAGAPGGKSGALNEVWPQTQGEFIAVFDADAQAPVDLLQQVLPRFQQPQLGAVQVRKAIANSGTNFWTRGQTVEMMLDAYLQQQRVAIGGIGELRGNGQFIRRAALERCGGFNEETITDDLDLAFRLHLDHWWIDCCIHPAVQEEGVVRSLALWHQRRRWAEGGYQRYLDYWPWLVRNRLGPQRSVDLAIFWLTQYILPTAAIPDLALALILKRSPLYGPLAGLTVGLTLISLLRGIRQARSHEARNPLPIGQSLLGVIYMLHWIPVMAYTTMRMAFWPKQLRWVKTVHVGETHSAPVA

SEQ ID NO: 15903 - protein, 53 aa, Glycine max; identical to SEQ ID NO: 12663

SEQ ID NO: 15904 - protein, 369 aa, Saccharomyces cerevisiae
MLRNTFFRNTSRRFLATVKQPSIGRYTGKPNPSTGKYTVSFIEGDGIGPEISKSVKKIFSAANVPIEWESCDVSPIFVNGLTTIPDPAVQSITKNLVALKGPLATPIGKGHRSLNLTLRKTFGLFANVRPAKSIEGFKTTYENVDLVLIRENTEGEYSGIEHIVCPGVVQSIKLITRDASERVIRYAFEYARAIGRPRVIVVHKSTIQRLADGLFVNVAKELSKEYPDLTLETELIDNSVLKVVTNPSAYTDAVSVCPNLYGDILSDLNSGLSAGSLGLTPSANIGHKISIFEAVHGSAPDIAGQDKANPTALLLSSVMMLNHMGLTNHADQIQNAVLSTIASGPENRTGDLAGTATTSSFTEAVIKRL

SEQ ID NO: 15905 - protein, 275 aa, Wolbachia endosymbiont of Onchocerca volvulus
MSLIKLSPTIAVTDKVNRLKSQGKEICVLAAGEPDFDTPGHIKKAAIQAINEGKTKYTAVDGTRELKGAIIDKLKRDNDLEYMPSQICVSAGAKQVLFNLLMATINPEDEAVIPAPCWVSYVDMVSFFGGLPVIAECKDNFKLTSELLRSKITEKTKWLILNSPNNPAGVVYTYDELKKIAQILLEYPHVNIITDDIYEHIVYDGKFFTIAQVEPRLYDRVFVVNGVSKAYAMAGWRIGYVAGRSDVVKAISILQSQSTSNPNSIAQAAAVEALN

SEQ ID NO: 15906 - protein, 185 aa, Arabidopsis thaliana
YPYIAGMGIYVVSRDVMLDLLRNQFPGANDFGSEVIPGAPFLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDINARI

SEQ ID NO: 15907 - protein, 418 aa, Rhodococcus sp. CIR2
MQEPTARPVGPYASGPPPAALTVHSASLDHFRAARLWRALVIGVVVVAYTLFALVTWPVRRRGRTLADAASEGLVNGFEVLGPTFVKVGQLMASSSGVFPAPLANACLRCLDDVPPVPAEEARRVIEADLGHPVDALFASFDDVPLAAASVAQVHGCVLPDGREAVIKVQRPDIFRRMVVDLRTAYWGARIPTLIRLDQRQQRRHQLRIQRVRTLAAPTRTADPTRRRRLLAGLQLEHAPANRGLADTDRPGHRPHPAMPQRPGLRRQRQTPLPLVQMRQQDLEPLPQPPVDLAHNRPTAPTRLKPQNTMLLPYSHSAFGSVATRPRAGWRRSPTRGRRARRRSPTAPRTNRGRPATGRTPTTRHHPRWRSRPGPGSLGSPRRSRRPRRARARSPPGAGPPGSATRWLSRRNPNWRRR

SEQ ID NO: 15908 - protein, 147 aa, Zea mays
MMMSAKKIAHLAKKWQRMAAQGRKRLTLGAAAAKEVDECCGSVASKGHCAVYTADGARFEVPLACLSTPVFRELLQMSQEEFGFAGGDGRITLPCDAAVMEYAMCLLRRGASAELEQAFLSTMAMSCHCAIYMAPYVGRARQQQIVV

SEQ ID NO: 15909 - protein, 358 aa, Oryza sativa; identical to SEQ ID NO: 9149

SEQ ID NO: 15910 - protein, 323 aa, Streptomyces coelicolor A3(2)
MNVTSASPAVDLGPAGEPEAGVVPRPLSRLSDADLGTLLMIRHFELAVLELFSQGRLHGTTHTCLGQEYIPVALYPLLDEGDYVFSNHRGHGHYLARFHDPHGLLAEIMGRAGAVCHGVGGSQHIYRDRYLSTGVQGQSLPVAVGVGLHLKQAEPGRIAVVHIGDGTWGEGAVYEALNMAQLWQVPVLVVVEHNGIAQSTPTERQMSGTVAARAAAFGVGHLRIDSVDVTDVRAALTPVVEQVRDRHRPYVVECVTHRVGPHSKGDDTRPAEVRERAARHDWYRRYRQDRPAQFAAADQAQAEAVAAVVREVGARPASRWEAR

SEQ ID NO: 15911 - protein, 1196 aa, ASPERGILLUS NIDULANS FGSC A4
MANDLGSALEHAGGKGQEREGISLKTFIASLAAALIIFAVEFLLFLVLKGKLTRIYQPRTYLVPDRERTEPSPPGLFKWISPIFRTSSSEFVQKCGLDAYFFLRYLRMLLKIFVPLGCIIVPTLITVNRVDGKNQTYKNGTDTGDRWNVTGLDQLAWGNVAPENTHRYWAHLVMAVILIVYVCFVFFDELRGYIRLRQAYLTSPHHRLRASATTVLVTTIPKKWLTVEALEGLYDVFPGGIRNIWINRNFDDLNEKVKERDRLALKLETAETELIIKCKKAQMKQAKAAAKKARRKGAEQKEQDVADTKASKPTIGAGISSGNPHQAHTLQEVLHRDTMASNDGRTHKRKYMNPLEPAVGLAGAVGQGVGKLGKSVLGTVKKHDHHGAPDEELPHQDNLSDANAADRSVWEGSAAMPAGESTEGDSSQPKRPFWRSRPSAMSKSSNRTEADELPLTAPESPVDVEDGEFSSSSGNSLTKARDENDIDITRNDGAEIEDDTYPVAYNENFEKEDLGEPLWKKYIRQEDRDTMRLPIFGISWMPSIWLLGKKVDTIDYCRKEVARLNLEIEIDQQHPERFPLMNSAFIQFNHQVAAHMACQAVSHHVPKQMAPRTVEISPDDVIWDNMSIKWWERYLRTFGVYAIVTGMVIGWAFPVAFTGLLSQLSYLEGAFTWLSWINRMPEWLISAVQGILPPLFLAILMALLPLMLRFLCRAQGLQTGMGIELTVQNYFFAFLFVQLFLVVAIASSFSTIIDNITNFTNWPELLAQNIPSSSNYFFSYMILQALSVSAGALVQIFSLVSWFILAPILDSTARRKWARTTNLNQMQWGTFFPVYTTLASIGLIYSVIAPLIMVFNVITFGLFWFVYRYNTLYVTKFRFDTGGLLFPRAINQLFTGIYVMELSLIGLFFLVRDTHGSVSCKGQAIIMIIMTILTVGFQILLNEAFGPLIRYLPITLEDDAVRRDEEFARVQRARLGLDDDNEEEAEEEQDTLEHRLKERERVEIQANEDSREIELKKIEGGISRRASGLRHKGQGLGPETAAKLGASRRPSWAVQTAQSPNRRSKYFGANSADAVPSIQRMREKLEKDAEAQGPVAGHSRSSALFAGIHDELEDLTPDERDQLVQRAFQHDALRSKRPVIWIPRDDLGVSDDEIYRTQRFSKHIWISNEYQALDGKCRTIFSRSPPDFSEVDLIQL

SEQ ID NO: 15912 - protein, 546 aa, Zea mays
MERSAESWWVLPMTLIPAISGEQHGNMATVATSFAYLAIFACLAWVGASLLYWAHPGGPAWGKYWRARGKKPSAAIPGPKGLPVVGSLGLMSGLAHRSLADEASRRPGAKRLMALSLGPVRAVVTSHPDVAKEILDSPAFAARPLNHAAYGLMFHRSIGFAEHGPYWRALRRVAAGHLFGPRQVEAFAPYRAAVAEGIVAALMRAGSGGAVVQVRGLLRRASLYYIMRFVFGKEYDVSRVLPPSGGEEVEKLLEMVHEGYELLGMENLCDYFPGLAALDPQGVGARCAELMPRVNRFVHGVIQEHRAKAVAGGDARDFVDILLSLQESEGLADADIASVLWEMIFRGTDAMAVLMEWTLARLVLHRDVQAKAHRELDKVVGADSQTTESAAPYLQALLKEALRMHPPGPLLSWRHRAISDTYVDGHLVPAGTTAMVNQWAISRDPEVWDAPLEFRPERFLPGGEGQDVSVLGADGRLVPFGSGRRSCPGKSLAMTTVTSWMATLLHEFEWLPASDDTGDVDLSEVLRLSCEMAVPLEVRVRPRSSV

SEQ ID NO: 15913 - protein, 448 aa, Leuconostoc mesenteroides subsp. mesenteroides ATCC 8293
MARKTFTKEEIKQIVADENVEFIRVTFTDVLGAIKNVEVPTSQLDKVLDNDLMFDGSSIEGFVRINESDMYLYPDLSTFMIFPWATDGHGGKVARLIADIYTADREPFAGDPRHALRTVLTEAREAGFTSFNVGTEPEFFLFKLDEKGNPTTELNDKGGYFDLAPLDMGENVRREIVLTLEKMGFEIEAAHHEVAEGQHEVDFKYASALEAADNIQTFKLVVKTIARKNGYFATFMPKPVAGINGSGMHTNMSLFTKEGNAFEDVSDEMGLSKAAYNFLGGVLEHATAFTALANPTVNSYKRLTPGFEAPVYVAWSASNRSPMVRVPASRGQSTRLELRSVDPTANPYTSLAAILASGLDGIKRELEPLASVDKNIYLMDEIERERAGITDLPDTLLAAVRELAADDVVRAAIGEHIADKFIEAKKIEYTSYRQYVSQWETDSYLEKY

SEQ ID NO: 15914 - protein, 192 aa, Buchnera aphidicola str. Bp (Baizongia pistaciae)
MGNILLLDNIDSFTYNLVDQLRSNFHQVFVYRNTVRKNIILKKLSKMINPILILSPGPGNPDNAGCMPQLLMELKGKLPIIGICLGHQAIVKMYGGHVGYSGEILHGQASLINHDNKAMFLGMSNPLPVARYHSLICSNIPNMLVVNAHFNNMVMAVRNDYEKICGFQFHPESILTTRGTEFLQRVIQWTKI

SEQ ID NO: 15915 - protein, 424 aa, Methanosarcina acetivorans C2A
MEFKQGDWVRIERNGTVYEGKVMPSMEGYITIKMKSGYNAGFSIDKVRITLLENNGETANGSRNGGKGCKTNEEELPEPGKKLPKIAILSTGGTIASKIDYRTGAVTSQFTADDILAAIPELKEIADFKGRVISSILSENMDSDSWQNLSKAVVEEIEAGADGVIVTHGTDTMMYSAAALSFMIKTPVPIVFVGSQRSADRPSSDNAMNAICAARVAISDIAEVVVVMHGTTSDDFCEIHRGTKVRKLHTSRRDAFKSVNSLPVGTVDYGTGEIKTFIDYTRRGEKALKFKPGMEPKCALVKFTPGADPTVLDYYISNGYKGLVVEGTGLGHISTKWIPLLRKATDAKMPVIVTSQCLNGRICDRVYDTGRDMLKAGAIEGEDTLPETALVKLMWVLGQTDDFEKAAGMLREDLSGEITECTQR

SEQ ID NO: 15916 - protein, 309 aa, Saccharomyces cerevisiae
MSHTETQTQQSHFGVDFLMGGVSAAIAKTGAAPIERVKLLMQNQEEMLKQGSLDTRYKGILDCFKRTATHEGIVSFWRGNTANVLRYFPTQALNFAFKDKIKSLLSYDRERDGYAKWFAGNLFSGGAAGGLSLLFVYSLDYARTRLAADARGSKSTSQRQFNGLLDVYKKTLKTDGLLGLYRGFVPSVLGIIVYRGLYFGLYDSFKPVLLTGALEGSFVASFLLGWVITMGASTASYPLDTVRRRMMMTSGQTIKYDGALDCLRKIVQKEGAYSLFKGCGANIFRGVAAAGVISLYDQLQLIMFGKKFK

SEQ ID NO: 15917 - protein, 316 aa, Photobacterium profundum
MDNKMNKITKAVIPVAGLGTRMLPATKAIPKEMLPIVDKPLIQYIVNECVAAGIKEIVLVTHSSKNAIENHFDTSYELEATLEKRVKRQLLDAVQSICPKDVTIMHVRQGHAKGLGHAVLCAKPLIGDAPFVVVLPDVILDEYTADQSRENLAAMLARYESTQASQIMVEPVPMHDVSKYGVVDCNGAALKGGESHPMTAMVEKPAMEEAPSNLAVVGRYVLSAKIWEKLAKTPPGAGDEIQLTDAIDMLMADETVEAFHMTGKSHDCGDKLGYLKAFVEYGIRHESLGDDFKDYLVSSLLVSSAEVASIEVASVE

SEQ ID NO: 15918 - protein, 352 aa, Glycine max
MARRSLPLLKHLLSRRIPARSGDHVTLIPGDGIGPMVTGAVEQVMEAMHAPVYFEKFEVHGNMKAVPPEVLDSIRKNKVCLKGGLVTPMGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 15919 - protein, 397 aa, Synechococcus sp. PCC 7942
MAANLLEQLRGMTVVVADTGDIQSIATFTPRDATTNPSLITAAAQMPQYQSIIDDTLRQVRTELGAEAPVEAIVAEAIDELFVAFGLRILEIVPGRVSTEVDARLSYDTEATIAKARKLIGLYERAGIRRDRVLIKIASTWEGIRAAEVLEKEGIHCNLTLLFGFHQAVACAEAGVTLISPFVGRILDWYKKESGRDAFPGAEDPGVQSVTQIYNYYKKFGYATEVMGASFRNISEIIELAGCDLLTISPGLLEELRQTEALLERKLDPAIAESLELEQIHLDRDRFAELHQADRMANEKLDEGIRGFCKAIDTLEGLLKQRLAVLEGKAVFHHAAHEVFSVCDLDGDGFITREEWLGSDAVFDALDLNKDGKLNEEDLLAGLGATLQMAGRAVATV

SEQ ID NO: 15920 - protein, 207 aa, Syringa vulgaris
ALVQLRRMENKINRQVTFAKRRNGLLKKAYELSVLCDAEVALIIFSNRGKLYEFCSTSNMLKTLERYQKCSYGSLEVNNSTRDLEESSNREYLKLKSKYESLQRHQRHLLGDELGPLNINDLEHLEHQLETSLKHIRSTRTQVMVDQLSDLQAKEKMMVETNTALERKLEEIYAANQLQQSWAGGEQSCAYSQQHLNLRTFFNLWMQ

SEQ ID NO: 15921 - protein, 198 aa, Streptococcus mitis
GIEDILVVTGKSKRSIEDHFDSNFELEYNLKEKGKHDLLKLVDETTGIRLHFIRQSHPRGLGDAVLQAKAFVGNEPFVVMLGDDLMDITDDHAVPLTKQLMNDYETTHASTIAVMPVPHEEVSAYGVIAPQGEGINGLYSVETFVEKPAPEEAPSDLAIIGRYLLTPEIFEILENQAPGAGNEIQLTDAIDTLNKTQR

SEQ ID NO: 15922 - protein, 960 aa, Streptomyces coelicolor A3(2)
MSAATPPFRDPQLPFAKRVDDLMSRLTLDEKTAFLHQFAPAVERLGIAPFRTGQEALHGVAWMGPATVFPQAVGLGATWNEELVRRVGEAVSKEARAMRARDDRVGLNVWSPTVNLLRHPLWGRNEEGYSEDPRLTSAVATAYTRGLRGDHPAYWRTAPVLKHWLAHNNETDRDTSSSSVRPRVLHEYDLRAFRDTVEAGAVAGVMPAYNLVNGRPNHLSPHLGRHLRTWTQEDLLVCSDAGAPSNLVDSEHYFDTHEEATAAALRAGVDSFTDHGTDSSKIVARVRGALEAGLLTEADVDAAVRRQLSVRFRLGEFDPENDPYSGAADTGADFDTPEHRALARDAAEQAVVLLKNDGVLPLAPETRVAVVGLLADECKLDWYSGTLIHRSTPLEGLYERFGADRVSFAEGVDRVRLRTADGRFLHVLPADDASAEAPGTEGALDPALLAGRTDLPPLTTDAVGTELALIDWGEGVLTLRASDGRYLSVAEDGFVRASADQPGGWVVQETFRLEPHDDGHLLRHTGTGRPVQVAADGVKVAAPDAAAGAAAGGAGSADAEVFELVVVERGEDAVTRVAAGADVVVVVAGNDPHINGRETEDRTTLRLPAQQERLLRAARAANPATVLALVSAYPYAVGVETLPAVLWTAHGGQAAGTALARILAGDVSPAGRLPQTWYSDDADLPGLLDYDVIGGRQTYLYFEGTPLFPFGHGLSYASFGYGDLTAQVRDGAVAVSFTVTNTGEVSADEVAQLYVRAEAPSVPRPRRELLAHRRLTLAPGASDRVSFEVPLSALAFWDVAHDRWRLEPGPYALLVGASSEDVRLTTTVTIDGEPAVPRPVGARGVQAVDFDEQSGTEIVDRTKAAGDAVAAVSGRTGELLYRDCDFGAGAAGVTVSVAGAGSVEVALDGGPAVAVLSPDAPTAGPYDYVELASAFTAEGVHDLRVTLRGALRLAHVGFSG

SEQ ID NO: 15923 - protein, 278 aa, Oryza sativa
  unsure (1)..(278): unsure at all Xaa locations
MARLVLLAVLPLLLLFVAGDSYATAAGGGGGGGGRRFDASRAVDVSWRPRAFLYEGFLSDAECDHLISLAKQGKMEKSTVVDGESGESVTSKVRTSSGMFLDKKQDEVVARIEERIAAWTMLPTECIIFYCFANFAILKLSENGESMQILRYGQGEKYEPHFDYISGRQGSTREGDRVATVLMYLSNVKMGDSLLPQARLSQPKDETWSDCAEQGFAVKPAKGSAVLFFSLHPNATLDTDSLHGSCPVIEGEKXWSATKWIHVRSYSYRRRSAGKCED

SEQ ID NO: 15924 - protein, 378 aa, Burkholderia fungorum
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 15925 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINDSGVNNTAYHGYWARDFKKTNPAYGTIADFQNLIAAAHAKNIKVIIDFAPNHTSPASPDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 15926 - protein, 308 aa, Salmonella enterica subsp. enterica serovar Typhi Ty2
MARAMDNAILETILQRVRPLIGQGKVADYIPALASVEGSKLGIAICTVDGQHYQAGDAHERFSIQSISKVLSLVMAMRHYPEEEIWQRVGKDPSGSPFNSLVQLEMEQGIPRNPFINAGALVVCDMLQGRLSAPRQRMLEVARALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRLVY

SEQ ID NO: 15927 - protein, 753 aa, Shigella flexneri 2a str. 2457T
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGNRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKAMKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSTDGSFMDELLTLMAEHRVWSRIPKIDKIPA

SEQ ID NO: 15928 - protein, 533 aa, Saccharomyces cerevisiae
MTEDNIAPITSVKVVTDKCTYKDNELLTKYSYENAVVTKTASGRFDVTPTVQDYVFKLDLKKPEKLGIMLIGLGGNNGSTLVASVLANKHNVEFQTKEGVKQPNYFGSMTQCSTLKLGIDAEGNDVYAPFNSLLPMVSPNDFVVSGWDINNADLYEAMQRSQVLEYDLQQRLKAKMSLVKPLPSIYYPDFIAANQDERANNCINLDEKGNVTTRGKWTHLQRIRRDIQNFKEENALDKVIVLWTANTERYVEVSPGVNDTMENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYMKPVGDSKVAMDEYYSELMLGGHNRISIHNVCEDSLLATPLIIDLLVMTEFCTRVSYKKVDPVKEDAGKFENFYPVLTFLSYWLKAPLTRPGFHPVNGLNKQRTALENFLRLLIGLPSQNELRFEERLL

SEQ ID NO: 15929 - protein, 353 aa, Zea mays
MSARLLRRVLQEREATPQDTDVADDDQSVEEEASPPRSSARNLFDLLDDGNGDGGEEDEKEDETEIIQAVSYTEQRHSVQKKANAVPETNKKSKKKKKKSKAEPSSTKAKDAQSLESILEDLCIEKNPIQQRAHQSDRAAGKEFETNEATHVASSVLAIDPKHLKGENEMRRIFGSKVVDSFENQRSMPSSSRQVRGARRVAHNPRKTLLVSPPSYWPPWDKSITMDLLEMKNGLNYFRYTYDPSVSHVQELFEKRQAANDLNAIAAILGKYPYHPESLLTFAELFKYSGEHQSSADAVEKCLFALECAWHPLFSPLQGNYQLKFNHDTNKPLFTALFSHMKNLDRRGCHRSA

SEQ ID NO: 15930 - protein, 175 aa, Triticum aestivum; identical to SEQ ID NO: 7158

SEQ ID NO: 15931 - protein, 122 aa, Zea mays
STWRSWLEDSQKIEETDEARKKFSNAKAISSSQFFGTQNREEKEAQLSLQKFAGSSSISSADLFGRNDADNSNLDLSAADLINRISFQASQDLSSLKDIAGETGKKLTSLASNFISDLDRIL

SEQ ID NO: 15932 - protein, 132 aa, Oryza sativa
WGEPKARTIAGIEARGFIFGPAIALAIGAKFIPLRKPKKLPGEVINETYVLEYGTDCLQMHVGAIEPGERVLIVDDLVATGGTLCAAIRLLERAGADVVECACLIGLPKFKDFYKLNGKPVYVLVESREYEK

SEQ ID NO: 15933 - protein, 497 aa, Staphylococcus aureus subsp. aureus N315
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 15934 - protein, 518 aa, Callistephus chinensis
MTILPFIFYTCITALVLYVLLNLLTRNPNRLPPGPTPWPIVGNLPHLGMIPHHSLAALAQKYGPLMHLRLGFVDVVVAASASVAAQFLKTHDANFASRPPNSGAKHIAYNYQDLVFAPYGPRWRMLRKICSVHLFSTKALDDFRHVREEEVAILTRVLVHAGESAVKLGQLLNVCTTNALARVMLGRRVFADGSEGRGVDPKADEFKDMVVELMELAGEFNIGDFIPPLDCLDLQGITKKMKKLHARFDKFLNIILDDHKIEKGAAGRRHSDLLTTLISLKDVDAADDDEEGKLSDIEIKALLLNLFAAGTDTSSSTVEWAVAELIRHPELLKQAREEMDIVVGRDRLVTELDLSRLTFLQAIVKETFRLHPSTPLSLPRMASESCEVDGYYIPKGSTLLVNVWAIARDPKMWTNPLEFRPSRFLPGGEKPDADIKGNDFEVIPFGAGRRICAGMSLGMRMVQLLIATLVQTFDWELANGLDPEKLNMEEAYGLTLQRAEPLMVHPRPRLSPHVYESR

SEQ ID NO: 15935 - protein, 654 aa, Hydrilla verticillata
MFSSYALARTGHLSCNPCTELRPKVSKGGSSCVYQRTFVRCCGNGAPSRRVATASLEARNSVVLKEPEAMEGALNGSAVVDSPSAVSGGVRDTYGEDRATEDQLLTPWTASVASGNSLLRDPRLNKGLAFTEKERDAHYLRGLLPPVFLTQEIQEKKLMTNLRQYQVPLQRYMAMMDLQERNERLFYKLLIDNVEELLPVVYTPTVGEACQKYGSIFRRPQGLYISLREKGKILEVLKNWPERNIEVIVVTDGERILGLGDLGCQGMGIPVGKLALYTALGGVRPSACLPVTIDVGTNNENLLQDEFYIGLRQKRARGKEYAELIEEFMSAVKQNYGERVLVQFEDFANHNAFELLTKYSKSHLVFNDDIQGTASVVLAGLIASLKLVGGTLAEHTFLFFGAGEAGTGIAELIALQMSKETGVPIEETRKKIWLVDTKGLIVSSRKESLQHFKQPWAHDHEPVQDLLDAVKMIKPTVLIGSSGVPNKFTQDVVEAMASFNEKPVIFALSNPTSNSECTAEQAYTWSKGRAIFASGSPFDPVEYEGQTYTSGQANNAYIFPGFGLGLVMSGAIRVHDDMLLAASEALAEQVTEENFEKGLIYPPFTNIRKISANIAAKVAAKAYELGLSGHLPRPENLVEYAESCMYSPVYRSYR

SEQ ID NO: 15936 - protein, 373 aa, Saccharomyces kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAVDFFVRGMVKSPIHVVGLSELPKVYELMEKGKILGRYVVDTAK

SEQ ID NO: 15937 - protein, 161 aa, Zea mays
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVEPSLFPMLGKWEREHTMEDILSSLKREMSTPQNRRLYQPHEGNEDQRVEQKGLSLRCAVM

SEQ ID NO: 15938 - protein, 338 aa, Paracoccidioides brasiliensis
MVVKVGINGFGRIGRIVFRNAVEHDDVEIVAVNDPFIETKYAAYMLKYDSTHGQFKGDIQHSSSNNLTVNNKTIHFYQERDPANIPWGKHGVDYVVESTGVFTTTEKAKAHLSGGAKKVIISAPSADAPMFVMGVNEKSYRPDISVLSNASCTTNCLAPLAKVIHDNFGIAEGLMTTIHSYTATQKTVDGPSHKDWRGGRTAAQNIIPSSTGAAKAVGKVIPALNGKLTGMAMRVPTANVSVVDLTCRTEKPVTYDQIKAAVKAASEGELKGILGYSEDALVSTDLNGDPRSSIFDASAGIALNDRFVKLISWYDNEWGYSRRVLDLIAYIAKVDAGK

SEQ ID NO: 15939 - protein, 497 aa, Pseudomonas fluorescens PfO-1
MFELADWQRKAAELSYPYQAVIDGKLRAAQSGQTFAAINPATGQLLANVAACGEEDVDAAVQNARQVFEAGTWAGRSPTERKQVLLRLADLILAHREELALLDSLNMGKPVMDAYNIDVPGAAGVFRWYAESLDKLYDQVAPSASNVLATITREALGVVAAVVPWNFPLDMAAWKLAPALAAGNSVILKPAEQSPFSALRLAELALEAGLPAGVLNVLPGLGEQTGKALGLHPDVDCLVFTGSTQVGKYFMQYSAQSNLKQVWLECGGKSANLVFADCQDLDLAAQKAAFGIFFNQGEVCSANSRLLVERSIHDEFVERLKAQAERWQPGDPLDPASAAGAIVDTRQTESILRFIHQAEREGATRVCGGRQLSFNGSDNFVQPTIFTDVQPHMTLFREEVFGPVLAVIPFDDEAHALHLANDSVYGLAASLWTDDLHRAHRVARQLRAGTVSVNSVDALDVTVPFGGGKQSGFGRDLSLHSFDKYTQLKTTWFQLRS

SEQ ID NO: 15940 - protein, 499 aa, Nicotiana tabacum
MQFFNFFSLFLFVSFLFLFKKWKNSNSQTKRLPPGPWKLPILGSMLHMLGGLPHHVLRDLAKKYGPIMHLQLGEVSLVVISSPGMAKEVLKTHDLAFANRPLLVAAKIFSYNCMDIALSPYGNYWRQMRKICLLELLSAKNVKSFNSIRQDEVHRMIKFFRSSPGKPVNVTKRISLFTNSMTCRSAFGQEYKEQDEFVQLVKKVSNLIEGFDVADIFPSLKFLHVLTGMKAKVMNTHNELDAILENIINEHKKTSKSDGESGGEGIIGVLLRLMKEGGLQFPITNDNIKAIISDIFGGGTETSSTTINWAMVEMMKNPSVFSKAQAEVREILRGKETFGEIDVEEFKYLKMVIKETFRLHPPLPLLLPRECREEIDLNGYTIPLKTKVVVNAWAMGRDPKYWDDVESFKPERFEHNSMDYIGNNYEYLPFGSGRRICPGISFGLANVYFPLAQLLNHFDWKLPTGINPRNCDLTEAAGAACARKNDLHLIATAYQHCEE

SEQ ID NO: 15941 - protein, 124 aa, Zea mays
RRRRRRAAAAAAPKGCVTVRVGLEGEEQRRFAVPLGHLKHPLFGALLEEAEREYGFRHQGALAIPCRVDRFVQLERLIGRDLRGASCAHHLVDLDGALASGGGAHHHHQHHHLHLPRFVGCFRA

SEQ ID NO: 15942 - protein, 92 aa, Zea mays
  unsure (1)..(92): unsure at all Xaa locations
GFVIPHPSRANPANPSIXLGPEFKKVANFLARVKSLPRIVXLSSLKVFGEVWFGSGNTPKGKVAIFPQPGVKLEIPKGDVLXNKDVNGPEDF

SEQ ID NO: 15943 - protein, 120 aa, Glycine max
  unsure (1)..(120): unsure at all Xaa locations
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 15944 - protein, 174 aa, Synechocystis sp. WH 8501
MQSTRKSLSQSIDIPNLDTLAQELAAIQQTGSKRIALLGSRHVPITHQQLIEMMSYALVLGGNRLMTSGATGTNAAAIKGAMRADPNLLTVILPQSLSKQPRESKEQLERVIHLVENPENDGLSLGEASALCNREIVSRCQQLICFAFHDSHTLLQTCEEAEEQRKLVTLFYFD

SEQ ID NO: 15945 - protein, 379 aa, Arabidopsis thaliana
MESELKDLNSNSNPPSSKEDRPLLKSESDLAAAIEELDKKFAPYARTDLYGTMGLGPFPMTENIKLAVALVTLVPLRFLLSMSILLLYYLICRVFTLFSAPYRGPEEEEDEGGVVFQEDYAHMEGWKRTVIVRSGRFLSRVLLFVFGFYWIHESCPDRDSDMDSNPKTTSTEINQKGEAATEEPERPGAIVSNHVSYLDILYHMSASFPSFVAKRSVGKLPLVGLISKCLGCVYVQREAKSPDFKGVSGTVNERVREAHSNKSAPTIMLFPEGTTTNGDYLLTFKTGAFLAGTPVLPARHILFLLCQVVNHLEVIRLPVYYPSQEEKDDPKLYASNVRKLMATEGNLILSELGLSDKRIYHATLNGNLSQTRDFHQKEE

SEQ ID NO: 15946 - protein, 289 aa, Agrobacterium tumefaciens
MPTSDGTLYGFKYVNGHPKNTKSGRQTVTAFGVLSDVDSGYPLLLSEMTILTALRTAATSAIAAKYLARKDSRTMALIGNGAQSEFQALAFKALIGVDRIRLYDIDPEATARCSRNLQRFGFQIEACTSAEQAVEGADIITTATADKHNATILSDNMIGPGVHINGVGGDCPGKTEMHRDILLRSDIFVEFPPQTRIEGEIQQLAPDHPVTELWRVMTGQDVGRKSDKQITLFDSVGFAIEDFSALRYVRDRVEGSSHSSPLDLLADPDEPRDLFGMLLRRQAFRRLGG

SEQ ID NO: 15947 - protein, 294 aa, Helianthus tuberosus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKAGLDLLCKMLWLDPSKRITARTALEHEYFKDIGFVP

SEQ ID NO: 15948 - protein, 536 aa, Brucella melitensis 16M
MQPLSKPLPPAMARKPNGWRGRISAQPRQGWRRNGLIGRMTMTQENKMGKHENKAGGASLLHYGNFIAGQWQDAVGGEHITLKNPSDGSDLALIARGAKADIDLAVVAARSALSGDWGKLTATERGRILHRISEEVLKNIDLLTDLESKDVGKPVTQARVDVVALARYLEFYGASADKVHGDTLPYQNGFTVLSIYEPHGVTGHIIPWNYPMQILGRSLGAALAMGNAAVVKPAEEACLTILEFARIAEKAGLPKGALNVVTGFGAEAGAALCEHPDVNHISFTGSVRTGEVVQAAAAKNTVPVTLELGGKSPQIVFADADLDRALPFLVNAGIQNAGQTCSASSRILVERSIYEEVIARMSERYRALKVGPASADLSVGPVVSQRQKAIVDGYLDLAKESGLAIAAQGVLAEGAPEGGAYVLPTLIRDVPADHRLAQEEIFGPVQVILPFDTEEEAIANGTHYGLVCGIWTNDGGRQFRLAHAIHSGQVFINNYGAGGGIELPFGGVKKSGHGREKGFEALYGFASLKTISVYHG

SEQ ID NO: 15949 - protein, 174 aa, Glycine max
MQSQVVCNGCRSLLLYPRGATNVCCALCNTITSVPPPGMEMSQLYCGGCRTLLMYTRGATSVRCSCCHTVNLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 15950 - protein, 358 aa, Medicago sativa subsp. X varia
MENGKVHVVKPQSEARLAILELAHIMSVPTSLVAVLKMKVPEAIWQGGKNTPLSASQILSIVRPNGGGDAENLQRILRLLTTYAIFAEDLSSNGKRKYSLTDIGKALVPDDDGLSYATYVLQHYQDQYLRAWPLVGDAVEDASVEPFEKLHGEGAYAYCMKRPDEMSLFYASMSGLSMPHMNEMLEKYDGFKGVETLVDVGGNSGVILNMIMNKYPNILKGINFDLPDMISSAPQLPGITHVGGDALESVPAGDAIFTKWTMLTWTDEECKKVLQNCYKALPVNGKLIVCEPVSPELTDESQRTRALLSGDIFIMTMYRTKGKHRTEEQFKQLGISTGFLRFRAFHIDPYFPVLEFQK

SEQ ID NO: 15951 - protein, 255 aa, Rhizobium sp. NGR234
MSKSRLWVGTSWKMNKTLSEAIAFADGLAAADAKRDDRIQRFVIPPFTVVREMKERLKETSVKIGAQNMHWEDAGAWTGEISPLMLKDCGLDLVELGHSERREHFGETDRSVGLKTAAAVRHGLVPLICIGETLAEREAGEADAVLKRQVEGAFALLDGAAKQAPILLAYEPVWAIGVNGIPATADYADARHQRIAEVAEAALGVAVPVLYGGSVNPGNCEELIAQPHVDGLFIGRSAWEVDGYLDILERVAGTI

SEQ ID NO: 15952 - protein, 702 aa, Oryza sativa
MELSSLAALLHSPLLLAVLLLVFSWLIVSSTKKRPPPPCGDGGRRLPLPPSPPGVPLLGHLPLLGTLPHRKLRSMAEAHGPVMLLRLGRVPAVVASSAAAAEEVMRTRDLAFASRPRVRMSERLFYGRDMAFAPYGEFWRQARRVTVLHLLSPRRVLSFRGVREQEVAALLDRVRRRCGGGGETVNLSDLLMSYAHGVISRAAFGHGGAHGFDGDEGGEKLRKLFADFEGLLGTMTVGEFVPWLAWVDKLTGLDAKVARTSAAMDGLLERVIADHRERRRSRGQAVGDGEADADHRDFVDVMLDVSEAEEGAGAGAGGVLFDTVAIKAVILDMMAAGTDSSFTTTEWVMAELINHPRVMRKLQDEIRAVVGTSSASAAAAATGGGQVTEDHLGELPFLRAVIKEMLRLHAPGPLLLPRETVEDTELLGYRIPARTRVIINVWAIGRDAAAWGDSAEEFVPERWLDGGGGGGVEYAQQLGKDSRFVPFGAGRRGCPGAGFAALSVELALANLLYHFDWELPPPAASGIMATTRLDMDELFGLSVRLKADLNLVAKPWAAWHEGDEDIPGDVCSEEQITAEGVGGHLATGRDSCGGDRWQIGSPRKASVATWRREDFVRRGSVDQDGDRRRRESWQRTGDGDRVGRAGGGDRWQIGDADDGAAADREGSTDGGALSGVSACGSGILAVAQVRVGERERERRFRD

SEQ ID NO: 15953 - protein, 496 aa, Burkholderia fungorum
MGHMNETPALPAWLDGSPKLLLIDGQPTPARSGRTFETINPTTGKALAQIAEADEKDIDLAVAAARRALDGPWGRFKPFDRQAVLLKLADLVETHFDELALLDTLDMGGPIRSTGAKRTRAIGLLRFYAGLATSIHGSTIDNSQAGEVISYTVKEPVGVVAAINPWNGPLGLAIWKIAPALAAGCTVVLKPAEQAPLSPLRFGELCLEAGIPQGVVNVVTGFAGAGAALAAHPGVDKVAFTGSTEVGQHIIRASAGNIKRVSLELGGKSPNIVFADANLDAAVPGAAMAVFANSGQICSAGTRLFVQRSIHEEFVERLSSFAKTLRVGNPLDPDTQLGPLVSEAQLKRVTSYLDKGREEGARAVAGGTRLQNDELKNGYFVEPTVFDGVKDDMAIAREEIFGPVISVLPFDTAEEAVQRGNDTEYGLGSGVWTRDIGNAHRVARGLRAGSVWVNCYQVMDPAVPFGGYKMSGYGRESGVEHMEEFLQTKAIWIKTD

SEQ ID NO: 15954 - protein, 120 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 15955 - protein, 505 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 15956 - protein, 178 aa, Triticum aestivum
  unsure (1)..(178): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGYYDGRYWXTCGKLPMFGXTDATKGVQRRWRXAKKGLPDAFVRIIGFQKHXQVQXVRFIASXQPGWKESRKG

SEQ ID NO: 15957 - protein, 320 aa, Brassica juncea
MEKNIKFPVVDLSKLIGEERDQTMALINDACENWGFFEIVNHGLPHDLMDNAEKMTKEHYKISMEQKFNDMLKSKGLENLEREVEDVDWESTFYLRHLPQSNLYDIPDMSDEYRTAMKDFGKRLENLAEDLLDLLCENLGLEKGYLKKVFHGTKGPTFGTKVSNYPACPKPEMIKGLRAHTDAGGIILLFQDDKVTGLQLLKDGDWIDVPPLNHSIVINLGDQLEVITNGRYKSMMHRVVTQKEGNRMSIASFYNPGSDAEISPASSLACKETEYPSFVFDDYMKLYAGVKFQPKEPRFEAMKNANAVTELNPTAAVETF

SEQ ID NO: 15958 - protein, 336 aa, Staphylococcus aureus subsp. aureus Mu50
MNREMLYLNRSDIEQAGGNHSQVYVDALTEALTAHAHNDFVQPLKPYLRQDPENGHIADRIIAMPSHIGGEHAISGIKWIGSKHDNPSKRNMERASGVIILNDPETNYPIAVMEASLISSMRTAAVSVIAAKHLAKKGFKDLTIIGCGLIGDKQLQSMLEQFDHIKRVFVYDQFSEACARFVDRWQQQRPEINFIATENAKEAVSNGEVVITCTVTDQPYIEYDWLQKGAFISNISIMDVHKEVFIKADKVVVDDWSQCNREKKTINQLVLEGKFSKEALHAELGQLVTGDIPGREDDDEIILLNPMGMAIEDISSAYFIYQQAQQQNIGTTLNLY

SEQ ID NO: 15959 - protein, 473 aa, Triticum aestivum; identical to SEQ ID NO: 13593

SEQ ID NO: 15960 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 15961 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 15962 - protein, 481 aa, Onikusa foliacea
RTRIKNQRYESGVIPYAKMGYWDPDYAVKETDVLALFRVTPQPGVDPVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGDDVVLQFGGGTIGHPDGIQAGATANRVALEAMVIARNEGRDFVAEGPQILRDAAKTCGPLQTALDLWKDISFNYTSTDTADFVETPTANV

SEQ ID NO: 15963 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 15964 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 15965 - protein, 290 aa, Helicobacter pylori J99
MDYKRFKGKHANIVIEIISLLEKGVKKAQEILEKPDAGSYTQLENSSGDTPIKADLALDKFLEETFLSLENVKSVFSEEKETPVTKENGSYLIAYDPLDGSSVMEANFLVGTIIGVYEKDYKAQNLVASLYVVFGHKIELVVALEEVYRYAFYQNKFHFIETIVLENKGKIIASGGNQKDFSLGLKKALEGFFAENYRLRYSGSMVADVHHVLVKKGGMFSYPQKKLRKLFEVFPLALMVEKAKGEAFYFDKGVKKRLLDQSVESYHEKSECYLASPHEAQILEKHLKGE

SEQ ID NO: 15966 - protein, 196 aa, Oryza sativa
MAARKFFVGGNWKCNGTGEDVKKIVTVLNEAEVPSEDVVEVVVSPPFVFLPQVKGLLRPDFSVAAQNCWVRKGGAFTGEISAEMLVNLQVYDDNEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 15967 - protein, 68 aa, Triticum aestivum
  unsure (1)..(68): unsure at all Xaa locations
MVQELAKYQLAAGLANDIASHIEQIAEADLNIDAVCMAFYARTEEAGXSDSVHKLAVCTIALEEALSN

SEQ ID NO: 15968 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRMEVRFPDPAANPYLCFAALLMAGLDGIKNKIHPGEAMDKNLYDLP

SEQ ID NO: 15969 - protein, 251 aa, Oryza sativa
  unsure (1)..(251): unsure at all Xaa locations
MDPGGLRPAPQSAAAAAAAAAAGAGAGASAADEPRDARVVRELLRSMGLSEGEYEPWLVHQFLDLAXYRYVGDVLGDAQVYADHAGKPQLDADDVRLAIQSKVNFSFSQPPPRECSEFFHSDQDFRSRSLPSDNPLFFSMVLLEVARNRNKIPLPKSIAPPGSIPLPPEQDTLLSQNYQLLAPLKPPPQFEETEDDNAGANPTPTSNPSNPSPNNLQEQQQLPQHGQRVSFQLNAVAAAKRRGTMDQLNMG

SEQ ID NO: 15970 - protein, 372 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPWNSLLQHNSGYKPADLKECVLIIHDLQLSKRGSSLVAVRDKYKQHKFKCVSTLTAPPSIPDEFFEDI

SEQ ID NO: 15971 - protein, 606 aa, Eremothecium gossypii
MAAIQLEKTLVPLPSTRRNFGTHLSYDRHTNRIAYGSGKSAIVKSLDSDIVVQFTGHGSANVTVVRFSPVAGSQYVVSGDDAGRIMVWSYFEDEEKGQVETKLRSEFQVLAGAVADISWDFEGRRLCVVGAGRDRYGAFISWDTGNSLGEVTGHALNVNACHIRQARPMRAATVSDDGSMVFYKGPPFQFSCSDHTHHANGKFVRDVRFSPAKGAYLVSVGSDRKIVLYDGDSGEFIKYIGEDSEECGGFFSLAWVDDGDKSNRIVTASADGVVRLWDVEANRLLKRWELGTEVAQQQVGVVVTRDSNIISVSLDGTLNVFSIESDKPIKTIEGHKKGITALKTNPLVTASYDGRVLEWSAEGTAAVAAMHSNSVTSINNVGGRTCTVSWDGTLKVDNEEKHKFPDDPKASVAFEGMVALITNNKRLVLVKSESGLVVQETALSRSPCVVTMAKSHVAVGYEDSNIIDVFLVSDFATRFELALTIRGTPSALSFSPTEQYLAVGDVMGKILLFNVEQRTVVTSRWSFHTGKITSMDWRPDEDDENYIATAALDTHLFIYSVKKPMRVIKMLNAHKDGINMLGWEDPDHLITGGQDACIKRWRVSFS

SEQ ID NO: 15972 - protein, 129 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 15973 - protein, 469 aa, Triticum aestivum
MAAWLARRAARRLASELRSRGPGPWPLSSSTVPVLGVPSGDQSRGFCSVRRFAGDSTAAAAVEEPENGLAAGDLQFVDFPGGKLSFVGEMNFLPESQRERINCYRVLDDDGGTIYSSRFQEVSKELALKMYSNMVTLQIMDTIFYEAQRQGRISFYLTSNGEEAINIASAAALSAQDIVLPQYREPGVLLWRGFTLQEFANQLFGNKLDYGKGRQMPIHYGSNRLNYFTVSSPIATQLPQAVGAAYSLKMDKKKACAITYFGDGGTSEGDFHAALNFAAVTEAPVIFFCRNNGWAISTPTAEQFRSDGVVTRGQAYGIRSIRVDGNDTLAVYSAVHTAREMAITEGRPILIEAMTYRVGHHSTSDDSTKYRPADEMEHWRTARDPVSRYRKWVQGNGWWCDTQESELRNNVRQELLQAIQVAERMPKHGLAELFTDVYDQMPSNLREQERSLLDTIKKHPAEYPADVPA

SEQ ID NO: 15974 - protein, 742 aa, Glycine max
  unsure (1)..(742): unsure at all Xaa locations
MWRLKIADGGKDPYIFSTNNFVGRQTWEFDPEAGTPEERAQVEAARQNFYNNRFKVKACGDLLWRFQILREKNFKQSIPSVKIEDGEEITYEKVISTLRRAAHHLSALQTSDGHWPAQIAGPLFFLPPLVFCMYITGHLDLVFPEEYRKEILRYIYYHQNEDGGWGLHIEGHSTMFGTTLNYICMRILGEGPNGGHENACARGKKWIHDHGGVTHIPSWGKTWLSILGVFDWCGSNPMPPEFWIIPSFLPMHPXFVGPITPLILQLREELFTQPYEKVNWKKVRHQCAKEDLYYPHSLIQDLVWDSLYMFTEPLLTCWPFNKLIREKALQVTMNHIHYEDENSRYITIGCVEKVLCMLACWVEDPQGDAFKKHLARVSDYLWVSEDGMTMQSFGSQEWDAGFAVQALLATKLIDEIGHSLAKGHDFIKKSQVRDNPSGDFKSMYRHITKGSWTFSDQDHGWQVSDCTAEGLKCCLLLSKLSPEIVGEKVKPERFYDSVNILLSLQSKKGGIAAWEPIGAQEWLELLNPTEFFEDIVIEHEYVECTGSAIQALVLFQKLYPEHRKTEIKNFIVNAVQFLEDTQTTNGSWYGCWGVCYTYGSWFALGGLAAAGKTYTNCNAIRKAVKFLLTTQREDGGWGESYLSSPKKIYIPLEGSRSNVVQTAWALMGLIYAGQSERDLTPLHQAAKLLINSQLEEGDWPQQEITGVFLKNCMMHYPMYRNIFPMWALAEYRRRVPLPSTEG

SEQ ID NO: 15975 - protein, 505 aa, Brucella melitensis 16M
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMEKALKRVEAIVQGDPLDPATMIGAQASSEQLEKILSYLDIGRQEGAEVLAGNERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENHLKMLDHYQNTKNMLVSYSPKKLGFF

SEQ ID NO: 15976 - protein, 246 aa, Lycopersicon esculentum
MGRGRVELKRIENKINRQVTFAKRRNGLLKKAYELSVLCDAEVALLVFSNRGKLYEFCSTSNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 15977 - protein, 397 aa, Zea mays
MMCVQVQGGGLSEFSGLLRSSASLPMCWNATSDEFISAVSFRNHAIGTSGGRLRWAPTEAKLKVAINGFGRIGRNFLRCWHGRDDDSPLDVIAINDTGDVKQASHLLKYDSMLGIFDADAELVGDNAISVDDKVIKVVSDRNPSNLPWGELSVDLFIEGTGVFVDHEGAGKHIQVGAKKVLITAPDKGNIPTYVVGVNADQYNPDEPIISNTSCTTNCRVPFVKVLDQKFGIIKGTMTTTHFYTCDQRLLDASHRDLRRARAAALNIVPTSTSAAKAVVLVLPNLKGKLNGIALWVPTPNVSVLDLVVQVSRKTLAEEVNQAFRDAAANELQGILEVCDVPLVSVDFRCSDFSSTIDASLTMVMGDDMVKVISWYDKEWGYSQRVVDLDDICANQWK

SEQ ID NO: 15978 - protein, 799 aa, Oryza sativa
MDGHPSPRSHHQPPPPERDGSFNYDIESMDGGGGAWRGRYESSEVLLRYDDEAGGGPRQPLLRKRTMNTTSQIAIVGANVCPIESLDYEIVENDLFKQDWRSRKKKQIFQYIVLKWALVLLIGMLTGIVGFFNNLAVENIAGLKLLLTSDLMLKQKCRYFTAFLAYGGCNLVLATTAAAICAYIAPAANIAGFNLLLTGNLMLKERYLTAFFAYGGCNLVLAAAAGFVLGKEGPMVHTGACIANLLGHGGSRKYHLTWNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIPTYTAQDVVAIIVLGIIGGVFGGLFNFLLDRILRAYSIINERGPPFKILLTMIISIITSACSYGLPWLAPCTPCPADAAEECPTIGRSGNFKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLHMLPLVMLVVLISKTIADSFNKGVYDQIVVMKGLPFMEAHAEPFMRNLVAGDVVSGPLITFSGVEKVGNIVHALRITGHNGFPVVDEPPVSEAPELVGLVLRSHLLVLLKGRSFMKEKVKTSGSFVLRRFGAFDFAKPGSGKGLKIEDLDLTDEELDMYVDLHPITNTSPYTVVETMSLAKAAVLFRALGLRHLLVVPKTPGRPPIVGILTRHDFMHEHIHGLFPNLGKSH

SEQ ID NO: 15979 - protein, 622 aa, Neurospora crassa
MPTNKAPTSNEWDLPKLRASINFQDDWKDPVSGESIAHEFFDVKFYPYNPVGAPPVFAIASKKHVIICRINQNTDSSTNPVEVLKLIRDDDDDAANCSCCWSKDMETGQPWLCIAGADAKVKVYDVKQGKLVKTLVGHGGGINDLVTSPLTPSLIASCSDDTTVRLWSLLPIHSAQPCMFILGGDAHTWDLLSIAFHDTGRYLLSAGHDQTINLWTIPPCPSEPVTHPLVIHYPHFSTKEIHNSLVDCVSFFGDLILSRACWEETIVLWSISGFSSSSSSFPSPSSSPSPSSSFQGNHLPLSTAPTTFDPSKLTRSAFWQAPDLNPETRPAYFTRLLQFKTVDCKGQFYMRFKILHAQGGKHPVLAFCNARNKFMFWDLSRLGSWQRFLGELRDAEEEQEAEEKNLKEGGREGRRKRVVEAPGWMPARKMPRRTAGATGEGGGGGGTTYSSTAAAAAATTAANYNKTTGGVGSGGRASGKQQQQLGTGTSTSPDPETLLSASAVAAGAAAGGGRPGSSSRERPGSRGSTTTTATATATATQTAASRAPGIGLGGYTQKQLDEWHDQCDITDSHKEIKPHKTVTVDGKGQHFVGRQVAWSPEGNWCVVVGNSNRAMIFQRWGK

SEQ ID NO: 15980 - protein, 426 aa, Spinacia oleracea
MAIEHEDDLKDEKNPRPLDEDDIALLKTYGLGPYSASIKKVEKEIKDMSKKVNDLIGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 15981 - protein, 636 aa, Glycine max
  unsure (1)..(636): unsure at all Xaa locations
MFIENFKVECPNVKYTETEIQSVYNYETTELVHENRNGTYQWIVKPKSVKYEFKTNIHVPKLGVMLVGWGGNNGSTLTGGVIANREGISWATKDKIQQANYFGSLTQASAIRVGSFQGEEIYAPFKSLLPMVNPDDIVFGGWDISNMNLADAMARAKVFDIDLQKPXRPYMESMLPLPGIYDPDFIAANQEERANNVIKGTKXQEQVQQIIKDIKAFKEATKVXDKVVVLWTANTERYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNSNAILYEPGEHPDHVVVPYVRHILNNNNMVWMFTRLIEDGIAVDHIVNNVALGDFLGAEGLWSREIHTIIVSQMVVTNYRCWLDTSPHKKINQHRFHFGLTTLEVISTNQSVPRDGKINQPWYKSVLRTSINERNIFHHTGNSIQGGRRNLSLISVHSSQEILHGVIKAYNQIAIPLCVGSPQDNHLVHFGGFLKRLDVFDDLLNLLLLCALNHVVGTLLLVGSNEIRVVDSGEWNHGFHVRPQLLLQIDVKHLCPGPWHQPGSCC

SEQ ID NO: 15982 - protein, 351 aa, Antirrhinum majus
MEGGGGSSSNSCMIGFGENTSSNNGFCPMTMMMMPPPSMASSHPNGNTLFFPLPSTNNSHQGLNHRTSASTMLEDQHNNNTITSTGYYFMDGNDNDSVKAKIMAHPYYHKLLAAYINCQKIGAPPEVAVKLEEACASAATMGRNSVSRIGEDPALDQFMEAYCEMLSKYEQELSKPFREAMLFLSRIECQFKALTLSSSDSACGEAMDRHGSSEEEIDVDNSLIDPQAEDRELKGQLLRKYSGYLGSLKQEFMKKRKKGKLPKEARQQLLDWWSRHYKWPYPSESQKLALAEQTGLDQKQINNWFINQRKRHWKPSEDMQFVVMDAAHPGHYYMDNVLGNPFAMDILPTLL

SEQ ID NO: 15983 - protein, 578 aa, Lactobacillus plantarum WCFS1
MTNNNEERPQWQVNQNRHTRFRTIVSVLRRYNVLSNLARQKNPDQVRAAFEELGPTFIKIGQILSSRTDIVKPEFANEFKKLQNNVRADDFSVVKQTIEQQTGKPINEMFAQFDERPFASASMGQTHHATLLNGQKVVVKVQHPGIDAEVALDISLFERALPLLRYIPESSVVDLREMVGEIKRSLFNELDTSIEVKNGLRFYRLNNADDIIRVPRVYAKYSTQKVLVNQYMPGTTIQHFMAQMLAADEDGNHQYDDERRYLAHVLVQNFLKQVFEDGFFHADPHPGNILLRELQPDDIGYHDTVPKHGGKIGKRQLPPYRLVYLDFGMMGEISPALMAGIANVVVAVTTEDTHQVGKAILAISNRTGVVDEEAFFSELAPFLSQYYNSGLGDIDFQGLLFEMVKVCRSNNIQMNPAVTMLGKAFGTIEGIVETLDPTLSMMDVARPFARKYIRENFNWRNELEDGMLASLQSLRDAPKIPSRLLSALDTFENGQTRVNLVFAHRKMFIDRIDSMVNKIVLSVILAALIVGSSLLVQSHPDNSWITNIGIFGYVSAVVVIIGLLIGTLHSWYTHWRRK

SEQ ID NO: 15984 - protein, 300 aa, Triticum aestivum
  unsure (1)..(300): unsure at all Xaa locations
RALGRAHRGPPHWXRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAITAGCSVVDPWAAIICGFVSAWVLIGLNKLAARFKFDDPLEAAQLHGGCGAWGVIFTXALFARSEYVEQIYGAPGRPYGLFMGGGGRLLGAHVVLILVIAAWVSCTMGPLFLALNKLGLLRISAEDEMAGMDQTRHGGFAYAYTDEDSSSRPGRGAGGSVGGFMLKSAQTSQVAADATSPSSSV

SEQ ID NO: 15985 - protein, 94 aa, Zea mays
MAKASSRLLFSLSLVVLLLLVETTTSPHGQAEAIDCGASCSYRCSKSGRPKMCLRACGTCCQRCGCVPPGTSGNEDVCPCYANMKTHDGQHKCP

SEQ ID NO: 15986 - protein, 519 aa, Candida apicola
MIIGLSDAFALGGIALSFLVAYQFIYFYFIYSPRAKKLGCAPPVIVFSFPLGLPALYKFATAMLHDNLLEYISIRIADMKVRTGFQTLAGQRWLVTLEPENIKTVLATSFKDYSLGFRYDIMYGLLGNGIFTLSGDGWKHSRALLRPQFSREQVSHLESMRTHINLMINNHFKGGQVVDAQALYHNLTIDTATEFLFGESTNTLDPDLAQQGLPGPKGLVTGEQFAEAFTSALEILSVRVIVGAAWFLIWTPKFWRSCKVCHNFIDYFVYKALATPMEKDQEADRYVFIRELTKETSDPRVIRDQALNILLAGRDTTAGLLSFITYYLGAYPEVYAELREAVLSEFGSTDVETPTFEQLKQCKVLQNVIREVLRLHPNVPLNFRQAIVDTKLPTGGGPNGDQPVFVPKGQNVFYSTYSMQRRTDIWGPDATTFRPDRWNEPREALASGWDYIPFNGGPRICLGQQFALTEASYTIVRICQEFSRIEVLHPDVITSKNSMKQRMRLTQTASGGVITRFIR

SEQ ID NO: 15987 - protein, 323 aa, Methanosarcina mazei Goe1
MGEKYFNSEEYNLTEFLFIGELTLTIKKALIPAAGLGTRFLPATKSMPKEMLPIIDTPVIQYVVEEAIASGIEDIIIITGRGKRAIEDYFDDSPELEMHLAKKHQTDMLKLVRDISSLVDIHYIRQKEPNGLGDAVLRAENHIGDEPFAVLLGDDIIVNDKPCTAQLIENFEKYGRSTIAVEEVPYEKLSSYGIIKGKPLDDSLYVLEDIVEKPAPEDAPSNIGAIGRYVFTPEIFDCIKHAGTGVGSEIQLTDGIRLLNKSQMIYACRFKGKRFDTGDRLGYVKSIVDFALQNENLRDDVLEYLREILAVNKISPEIDKLKQ

SEQ ID NO: 15988 - protein, 460 aa, Chondrus ocellatus
RDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAGTMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANV

SEQ ID NO: 15989 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVCDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 15990 - protein, 183 aa, Caulobacter crescentus CB15
MSEALKPGGGIKPDLPFTPVRVAVLTITDTRDEASDTSGQILVERIKAAGHELGGRVVVRDDIEQIRAQVRSWIDSKTVDAIVTTGGTGLTGRDVTVEALEPLFDKKIDGFSVVFHLVSYASVGLSTLQSRATAGLIESVFVFCLPGSNGAVKDGWDKVIAAQLDSRHKPCNMVELMPRLLER

SEQ ID NO: 15991 - protein, 212 aa, Glycine max
  unsure (1)..(212): unsure at all Xaa locations
MEVLVGPAFTIDVPSSPPRDGGSENRIFLNGSPEKDDGSNFRISGPPKFFAGGESESSSSIGTPDDSDNEEEEVQSQLKIRTGLGSLDAMEDSLPIKRGLSGHFDGKSKSFSDLSQVSNLSNLKELQKQESPFNKXERRVLIASKWSRRSSFYSWSNPQSMPLLPVDEDQDYDYEEEEEEEDDEEKARKVPSASSSSSSSLARKRNKKIRFS

SEQ ID NO: 15992 - protein, 557 aa, ASPERGILLUS NIDULANS FGSC A4
MIEELVSKTTPGQAVVYLLGAFFLACLARKIQVQWQLSRLGSRAPKIPFRLPYGLLIPSISRNSHADRRLSSAMDFIYKSMQANKSDQDLEYFTDVMRNAKGAPLAEDKKTVELDAGISSRIIFTRDPENIKAILTGQFSDYGKGESFHRDWREFLGDSIFVTDGEQWSASRHLIRPMFVRDRLVDTEIFEKHVQHLIPLLAGNNESKIVDVTSLFFRYTLDAATNYLLGQGTDSLQNPETEFAEAFRYVQRRQAQYFRLGVFKFVLSRTEFRRQLKVMDDFIKPYIDRVLAMSPAELDQKLSKSDTFLHALARFTRDRRTLRDQLVAILLAGRDTTAATLSFCLFELARNPEVTAKLREEIASRLGLGASAQKPSYTDLKEMKYLNAVLNESMRLYPVVPFNVRFSLKDTTLPRGGGPDGLAPVAVRAGTRVVYSTMIMQRSPENYDPPSAPNYFDPAQWNPERWLSGWQPKPWQFIPFNGGPRICIGQQFAMIEMGYTVVRILQAFERIQAVPEAGKSVVEDPRLRFEVTLTPASELNCVFVRDGEGREDEKISR

SEQ ID NO: 15993 - protein, 538 aa, Oryza sativa (indica cultivar-group)
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKARFDAPAYRDDRAGSTVPQADYAWRIVLMLGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGTTSGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPSTADHRTAPAPPA

SEQ ID NO: 15994 - protein, 250 aa, Oryza sativa (japonica cultivar-group); identical to SEQ ID NO: 13301

SEQ ID NO: 15995 - protein, 331 aa, Kluyveromyces marxianus
MVRIAINGFGRIGRLVLRIALSRKNIEVVAINDPFITVDYAAYMFKYDSTHGRFDGEVSHDGKALIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 15996 - protein, 356 aa, Neisseria meningitidis MC58
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 15997 - protein, 513 aa, Physcomitrella patens
MAIGKVLGCAGFQHSAVPTLREPVRLRAQCRRRGKTVSMSVQKTSKTVQQAEKMSQEFRQSSSTPLPLLHQVADALVQEMYAGLASEGGSDQLKMLPTYVENLPSGSEKGLFYAVDLGGTNFRVLRVELGGKTGQILSQEFKEVVIPPELMVGTGKDLFDFIAGTLASFVDTEDESIKAHFVQSGKTRESGFAFSFPVRQTSVKSGIVIHWTKGFKVDDAVGKDIVKQFQDAISRSNHQIMISALVNDTVGTLAGGRFNFDEETMIGCIIGTGTNACYVERADAVHKWDEPLPKSGEMVINMEWGNFRSPYLPRTFADETVDKDSVNPGDQWFEKMISGMYLGEIVRLVLARMAKEAELFGGNVPVKLLERLTLGTPHVSKIHLDNSPDLDVVAKVLKDVFEIETTTLEERKIVHEVCDIMGERGGRLAAAGLYGILKKIGRTGKSRNGSKKKTVIAMDGGLFEHHVRYRSYMEEALQELMGSDAAYEVALRLQNDGSGIGAALLAASHSHFK

SEQ ID NO: 15998 - protein, 135 aa, Oryza sativa
  unsure (1)..(135): unsure at all Xaa locations
MAPSVMASSATTVAPFQGLKSTAGMPVARRSGNSSFGNVSXNGGRIRCMQVWPIEGIKKFETLSYLPPLTVEDLLKQIEYLLRSKWVPCLEFSKVGFVXVRTTDSPXYYDGRYXWTMLEACPCFGCTXATQVLKE

SEQ ID NO: 15999 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSTFEQHSLDA

SEQ ID NO: 16000 - protein, 245 aa, Zea mays subsp. huehuetenangensis
SIRNNPVQNKLMNGEDPINNNHAQTAGGLGVRLATSSSSRDPSPSDEDMDGEVEILGFKMPTEERMRKRKESNRESARRSRYRKAAHLKELEDQVAQLKAENSCLLRRIAALNQKYNDANVDNRVLRADMETLRAKVKMGEESLKRVIEMSYSVPLSMPISAPDPQFGRSSAVPVPPPIRDSIVGYFSAPAADDDASVGNGFLRLQAQEPASMVVGATLSATEMNRVAAATHCAGAMELIQTAMG

SEQ ID NO: 16001 - protein, 328 aa, Shigella flexneri 2a str. 301
MNCSVLMAKRNNDMDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 16002 - protein, 268 aa, Glycine max; identical to SEQ ID NO: 2969

SEQ ID NO: 16003 - protein, 253 aa, Petunia x hybrida
MDLLQDRESETESLPYPTQCKRYKRIINSRISDTHYNQFLSLERRRQQQQQQYGKITEFPFVESEPVSSISDTSPDEDVANCLMMLSRDKWMTQENEVIDNSASYDEDVKTEDSVVVKVTTTRRGRGKYICETCNKVFRSYQALGGHRASHKKIKVSINETKNNGNVESEVQKDKIHECPVCYRVFSSGQALGGHKRSHGIGVAATNVSLSTKIVSSRISGTMIDLNIPATLEDDEISQIEVSAVSDDEFVNP

SEQ ID NO: 16004 - protein, 456 aa, Salmonella typhimurium LT2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 16005 - protein, 503 aa, Arabidopsis thaliana
MAITVPRRQLFIGGQWTEPVLRKTLPVVNPATEDIIGYIPAATSEDVELAVEAARKAFTRNNGKDWARATGAVRAKYLRAIAAKVIERKSELANLEAIDCGKPLDEAAWDMDDVAGCFEYYADLAEGLDAKQKTPLSLPMDTFKGYILKEPIGVVGMITPWNYPLLMAVWKVAPSLAAGCTAILKPSELASLTCLELADICREVGLPPGVLNILTGLGTEAGAPLASHPHVDKIVFTGSTTTGSSIMTSAAKLVKPVSLELGGKSPIIVFDDVDIDKAVEWTMFGCFWTNGQICSATSRLLVHERIADEFLDKLVKWTKNIKISDPFEEGCRLGPVVSKGQYERVLKFVSNARNEGATVLCGGVRPEHLKKGYFVEPAIVSNVTTSMEIWREEVFGPALCVKTFSTEDEAIQLANDSQYGLAGAVLSNDLERCDRVSKAFQAGIVWVNCSQPCFCQAPWGGTKRSGFGRELGEWGLENYLSVKQVTQYISDEPWGWYKPPSKL

SEQ ID NO: 16006 - protein, 165 aa, Triticum turgidum subsp. dicoccoides
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAYRPPGCE

SEQ ID NO: 16007 - protein, 817 aa, Vibrio vulnificus
MKPTQQKQFDKVSFQESVKKHLSATYAHTLENADSRAWYLAMGRALAELTTFDLLATETDKKIVEAKSVNYLSLEFLIGRLTGNNLISMGLYEQITEAMAELGQNLTDLLEEERDPSLGNGGLGRLAACFMDSLAAQEFPTVGYGLHYEYGLFKQSFEAGRQKEAPDAWRGVEGYPWEVARPELAQEIGFYGHVEVINEGGKERRQWVPGMHVKAMPWDLPIVGYESDTVYPLRLWECQAIAPFSLESFNNGNYFEAQHALIDAGNITKVLYPNDNHEKGKTLRLMQQYFHSAASVRDILRRHEAAGHTLASLPNFETIQLNDTHPTIAIPELMRILIDEKGLNWDEAWAICSKTFAYTNHTLLPEALETWSESLIQHLLPRHMEIIYEINHRFLQEVRAKWPGDVAKQQKLSIIQEGFHRMVRMANLCVIGSYAVNGVAALHSELVKRDLFPEFDELYPTRLQNVTNGVTPRRWLKFCNPGLSALISEKIGTDWPAHLEQLEGVAKFADDAKFQKEYMAVKKANKERLANWVKENMNIDLDTNAIFDVQIKRLHEYKRQHLNMLHILSLYHRLLNDANFDMAPRVVFFAAKAAPGYHLAKEIIFALNKIAEKINNDPRIGNKLKVVFIPDYRVSMAEIIIPAADVSEQISTAGKEASGTGNMKMALNGALTIGTMDGANVEIREEVGDDNIYIFGLEVDGVEALKAKGYNPFDYYNADPLLKASMDLLLGEEFTPGQPGLLRATFDSLLDGGDPYLCLADFASYVKAHEAMDKQYRDQAGWAKKAILNTALVGKFSSDRSIRDYVNNIWKLEAVHR

SEQ ID NO: 16008 - protein, 632 aa, Helicobacter pylori 26695
MKPTNEPKKPFFQSPIILAVLGGILLIFFLRSFNSDGSFSDNFLASSTKNVSYHEIKQLISNNEVENVSIGQTLIKASHKEGNNRVIYIAKRVPDLTLVPLLDEKKINYSGFSESNFFTDMLGWLMPILVILGLWMFMANRMQKNMGGGIFGMGSAKKLINAEKPNVRFNDMAGNEEAKEEVVEIVDFLKYPERYANLGAKIPKGVLLVGPPGTGKTLLAKAVAGEAHVPFFSMGGSSFIEMFVGLGASRVRDLFETAKKQAPSIIFIDEIDAIGKSRAAGGVVSGNDEREQTLNQLLAEMDGFGSENAPVIVLAATNRPEILDPALMRPGRFDRQVLVDKPDFNGRVEILKVHIKGVKLANDVNLQEVAKLTAGLAGADLANIINEAALLAGRNNQKEVRQQHLKEAVERGIAGLEKKSRRISPKEKKIVAYHESGHAVISEMTKGSARVNKVSIIPRGMAALGYTLNTPEENKYLMQKHELIAEIDVLLGGRAAEDVFLEEISTGASNDLERATDIIKGMVSYYGMSSVSGLMVLEKQRNAFLGGGYGSSREFSEKTAEEMDLFIKNLLEERYKHVKQTLSDYREAIEIMVKELFDKEVITGERVREIISEYEVANNLESRLIPLEEQAS

SEQ ID NO: 16009 - protein, 386 aa, Aspergillus flavus
MTGLDMETIFAKIKDEYARTDDVGKRQIQGHIRELQVGFYSDWDVVMRLSSGPLQVALAKVAIDLGIFRSLKESDTPITLAEFVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHFPILEELGKFPAPDKVLMVDIGGGFGQQSKALRAKFPNLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQAGLEIIQSKVYDSKEQAILVAVAKRT

SEQ ID NO: 16010 - protein, 491 aa, Triticum aestivum
MGEGGRRAAAGRPGLAAPGGRGALAPRVHARPAAAAPGCRRRGGRPRGAVGWLLVRGPWAPLGPSESARPDSYGCSPPRWLGRAGLHRALMCRRLPSVVTTPDAAGNARSPGRPSAAFPRSPGTARPSTTPLSPSPGAGPTAPATSRLVLGDGRPDDAAGPASRSLTVGAPTWGTADRHLGIDTVTELRNLTLRIIGQIFMGVADERTAAELESTYTERSYVMRAMAIDLPGFAYHKAIRARRRLVAALQCVLDERRARGAKTAGVDMMDRLIAAEDEGGRRLQDDEIIDVLVMYLNAGHESPGHITMWATVFLQENPEILAKAKAEQEAIMRSIPPGQKGLTLRDFRKMEYLSQVVDETLRFVNISFVSFRQATRDVSVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRVSSSH

SEQ ID NO: 16011 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINDGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 16012 - protein, 469 aa, Solanum tuberosum
MAPEFQKNAMYVSNELENGDVQKNFDDDGREKRTGTLLTASAHIITAVIGSGVLSLAWAIAQLGWVAGPAVLFAFSFITYFTSTLLADCYRSPGPISGKRNYTYMDVVRSHLGGVKVTLCGIAQYANLVGVTIGYTITASISMVAVKRSNCFHKNGHEASCSIESYPYMIIFAVIQIVLSQIPNFHKLSWLSILAAVMSFTYASIGLGLSIAKASGVGHHVKTALTGVVVGVDVSGTEKVWRSFQAIGDIAFAYAYSTVLIEIQDTLKSSPSESKVMKRASLAGVSTTTLFYVLCGTIGYAAFGNNAPGNFLTGFGFYEPFWLIDFANVCIAVHLVGAYQVFCQPLYGFVEGRCSERWPDSKFITSEYAMQVPWCGTYNLNLFRLVWRTTYVIVTAVIAMIFPFFNDFLGLIGAASFYPLTVYFPIEMYIAQRKIPKYSFTWVWLKILSWTCLISITCCSCWIDPGTCH

SEQ ID NO: 16013 - protein, 457 aa, Sphacelaria divaricata
  unsure (1)..(457): unsure at all Xaa locations
DYNVKDTDILALFRITPQPGVDPVEAAAAVAGESSTATWTAVWTDLLTACDIYRAKAYRVDPVPGTSDQYFAYVAYECDLFEEGSLANLTASIIGNVFGFKAVKALRLEDMRIPFAYLKTFQGPATGLXVERERLDKFGRPFLGATVKPKLGLSGKNYGRVVYEGLRGGLDFLKDDENINSQPFMRWKERFLYCMEGVNRAAAATGEVKGSYLNITAATIEQMYERAEFAESVGTVICMIDLVIGYTAIQTMAIWARKAQLILHLHRAGNSTYARQKNHGINFRVICKWMRMCGVDHIHAGTVVGKLEGDPLMVRGFYNTLLLTELKVNLAEGLFFDMDWASLRKCVPVASGGIXCGQMHQLLYYLGDDVVLQFGGGTIGHPDGIQSGATANRVALEAMVLARNEERDYVSEGREILRAAASTCGPLKAALDLWKDITFEYTSTDTPDFVEVATGSN

SEQ ID NO: 16014 - protein, 459 aa, Gelidium japonicum
DPDYVVKETDVLALFRVSPQPGVDPIEASAAVAGESSTATWTVVWTDLLTACDLYRAKAYKVEAVPKPTDQFFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEVKGHYMNVTAATMEEMYERAEFAKQLGTVIIMIDLVIGYTAIQTMAIWARKNDMILHLHRAGNSTYSRQKNHGMNFRVICKWMRMAGVDHIHAGTVVGKLEGDPEMIRGFYNTLLLTHLDKNLVQGIFFEQDWASLRKVTPVASGGIHCGQMHQLLDYLGNDVVLQFGGGTIGHPDGIQAGATANRVALEAMVIARNEGRNYVAEGPQILRDAAKTCGPLQTALDLWKDITFNYTSTDTADFVETPTANV

SEQ ID NO: 16015 - protein, 110 aa, Sandersonia aurantiaca
MATLGAPRDVPAGGENSADVEELARFAVAEHNKKENALLEFGRVVKAKEQVVAGTLHHLTVEAIDAGNKKLYEAKVWVKPWLNFKELQEFRHAGDSPSVTPADLGAKRGD

SEQ ID NO: 16016 - protein, 496 aa, Solanum tuberosum
MKKATVGAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTNSLNPGEQIFEKICSGMYLGEILRRVLLRMAEEAGIFGEEVPPKLKNSFILRTPEMSAMHHDTSSDLRVVGDKLKDILEISNSSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 16017 - protein, 503 aa, Triticum aestivum
MVATAKIPQRQLFIDGDWRAPALGRRLPVINPTTEASIGEIPAGTSEDVDAAVAAARAALRRNRGRDWARAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRDRCQRLAEEIDAGCIWVNCSQPCFCQAPWGGNKRSGFGRELGEGGIDNYLSIKQVTEYTSDAPWGWYKAPAN

SEQ ID NO: 16018 - protein, 356 aa, Triticum aestivum
MSPPSPLPSVAHHRNQSRHRLIRPGPSSFRSRPKNQMGILSLITGKPGASGFGSGSTAEQVTEGISAAGLTVLVTGGSSGIGLETSRVFALRGAHVIIAARNTEAASEARKRIMEIHPVARVDVLKLDLSSLKSVRAFADQFNSMNLPLNILINNAGVMFCPFQLSEDEVEMQFATNHLGHFLLTNLLLDNMKTTAKSTGIEGRIVNLSSVAHLHTYPKGILFDQLNDKKIYNDKMAYGQSKLANILHAKELSRRLKEEGANITVNCVHPGLIMTNLMRHSFALMKAIQVVTYLFWKNVPQGAATTCYVGLNPQLKGVTGKYFADCNEEKTSKHAKSDVLAKQLWEFSEELIRSAK

SEQ ID NO: 16019 - protein, 142 aa, Desulfitobacterium hafniense
MPGIPNDRTQPPMSNRLEQLRQLSAVVADTGDIDAIARFRPLDATTNPSLLLKAAGLPAYAPLIDAAVAQATGADRQARVADAGLRLAVAIGGEILKLIPGRVSTEVDARLSFDTQATLAQARRIVALYAEAGIGRERLLIK

SEQ ID NO: 16020 - protein, 181 aa, Glycine max
  unsure (1)..(181): unsure at all Xaa locations
MASSPTFSKVSLLLLVSLSFSYATSGFNHEHAYPPQSQAEMLTRNLNLFPKXPVNIIKGDFDSFVPGKIVEKKFSLLGHSGPSIQHLGHHAGHYSLPHSKAARMFYFFFESRNNKDDPVVIWLTGGPGCGSELALFYENGPFHIANNLSLTWNDYGWDQASNILFXDQPTGTGFSYSSDDS

SEQ ID NO: 16021 - protein, 830 aa, Chloroflexus aurantiacus
MKAVVMAGGEGTRLRPLTINRPKPMVSLVDRPVMQHIIELLKLHGITDIIITVQYLANVIQDYYGDGSAYGVNITYSLEEVPLGTAGSVKNAEHLLTEPFLVISGDALTDFNLSQIIEYHMASGATATVTLTRVSNPLDYGVIITDEQGRIRQLLEKPSWGEVFSDTVNTGIYVFNPDIFSYIERGKVTDWSKDVFPRMLHRGDRLQGYIANGYWTDVGTIEEYMRACGDYLSGKVNLPRVGHNIGGDIWVDRDAEIAPDAQLHGPIYLGHGAKIKGGVIIHGPSVIRDYTIVDSRANIDRSIIWRNSYIGERAELRGAIVLRQCNIRSRAMIFEGAVIGDGVQIGAGTVVQPNVKIWPSKEVDEGATVTSSIIWGSQGRRVLFGRYGITGLVNIEITPEMCARLGAAYGATLPRGATVTINRDAHFTPRMLKRAIIAGLPSAGVNVCDLRNVPIPIARYYTHASGAAGGVHVRISPFDNRVAEIKFFNHLGLDINSATERKIESTFFREDYRRAYLDEIGRIFYGEDVEETYRAAFMRALGQNAAFGKGFPIVIDYANTSTSTVMAEILRRMQADAVELNVYLDERMVFQTSADFEAAMNRLTKITPVVGAQFGVRLDPGGEKIFLIDDQGRRLHPLRALAAITALAMRANGGGVVAVPVTAPRAFEQIAARYGGSIIRTRANLGALMNLAAERADLLLLGDGTGNYIFPHFYPVADGMFAIARLMELLSLNQTTLSEVLADLPPYYLWQTRVPCRWESKGKVMRILNQQYHERHGEQIDGIKIELGEEWVLILPDPDGPFFHVIAEGVSEDHARILTDKYAGLVTSLQ

SEQ ID NO: 16022 - protein, 486 aa, Comamonas sp. JS765
MLAKQILNFINGEFVATGKWFDNRTPISNAVIGQVAEAGQAEVDAAVAAARAALKGPWGSMTLAQRVELLEALVAEITRRFDEFLEAECADTGKPRSLASHIDIPRGAANFKVFADVVKNVPTEFFEMATPDGRGAINYGYRKPVGVVGVICPWNLPLLLMTWKVGPALACGNTVVVKPSEETPRTAALLGEVMNHVGIPKGVYNVVHGFGPGSAGEFVTSHPGIDAITFTGETRTGEVIMKAAAKGARPVSLEMGGKNAAIVFADCDFDAAIEGTLRSAFVNCGQVCLGTERVYVERPIFDKFVAALKQQVEGWKIGVPEGADTQLGPLISKEHQAKVLSYYQLAVQEGATVVTGGGVPDMPGELKDGCWVQPTIWTGLPETARVIKEEIFGPCCHIAPFDTEDEVLAKANDNEYGLATAIWTRDLSRAHRVAQRMEVGISWVNSWFLRDLRTPFGGSKQSGIGREGGVHSLEFYTELKNVCIKL

SEQ ID NO: 16023 - protein, 128 aa, Rhodomonas salina
MRKKIRPLAPHLLVYKPQLTSIFSIFHRISAGILFVVFTILLFLSYCFDYYLNFFSFYFIFYYFFPFFNLIIYFVSYFLTFIFLFHMVNGLRHISWDFGLGLEIKNVYITGIIVFCISSLFVFVLILI

SEQ ID NO: 16024 - protein, 579 aa, Spirulina platensis
MQDQKQAVKRVTGAFALIDSLRRHGVQHIFGYPGGSNLPIYDEIYRAEQAGEIKHYLVRHEQGAAHAADGYARSTGKVGVCLATSGPGATNLVTGLATAYLDSVPVLAITGQVPRSALGTDAFQEIDIFGITLPIVKHSYLVREPSELPRIVVEAFHLAMSGRPGPVLIDIPKDVGNAQIDYIPVEPGSVRRVGYRPTERGNPRQINQALQLISEATKPLLYVGGGAIMAGAHAEIAELSERFQIPVTSTLMGKGRFDENHPLSLGIVGMLGMHGTAYANFAVMELDFVIAVGVRFDDRVAGTGDQFAHSAKVIHIDIDPAEVGKNRSTDVPIVGDVRQVLGDMLQRTYHWERKLSRNKPRNGTDLNQLREPIPLTVPHPEDGISPQDGDWELSHQCPDAFYTTDVGQHQMWAGQFVQNGPRRWMTSGGLGTMGYGLPAAVGVKVAHPHDTVTCISGDGSFQMNMQELGTIAQYGIGVKVIILNNGWLGMVRQWQHMFYNDRYEATNLEDGTPEFARLADVYGLEAMNVRQRKIYQRRLPKALSHKGPMILDVRVTRDEDCYPMVAPGHDNSDMMGLSS

SEQ ID NO: 16025 - protein, 338 aa, Glycine max
VDDNFLPTPRLYGCEKTTEGHEERGRVLQAMDGCGYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 16026 - protein, 380 aa, Oryza sativa
  unsure (1)..(380): unsure at all Xaa locations
KLSSSSHGGDDRVRQGAPDLRQQGQPHRRGRCVLLRWNLCKQKLGANAILAVSLAICKAGAIIKKIPLYQHIANLAGNKQLVLPVPAFNVINGGSHAGNKLAMQEFMILPTGAASFKEAMKMXVEVYHNLKSVIKKKYGQDATNVGDEGGFAPNIQENKEGLELLKTAIEKXAGYTGKVVIGMDVAASEFYNDKDKTYDLNFKEENNDGSQKISGDSLKNVYKSFVSEYPIVSIEDPFDQDDWEHYAKMTAEIGEQVQIVGXNDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 16027 - protein, 509 aa, Oryza sativa
MAATPGSSRPANVAAAAATEARFHSHPPQQDRRSGWAGCLSGLSCFGSQKGGKRIVPAARVPDGNASTSRGNAHQSGANSNQSAALNLSLLAPPSSPVSFSNSAIPSTAQSPNCFLSISANSPGGPTSNMFAVGPYANEPQLVSPPVFSTYTTEPSTAPLTPPPELAHATTPSSPDVPYARFLLSSMDLKTAGKDHNMPYLSTAYSGGSGLQASYPLYPESPSSSLISPASATPRTGLSSPIPEQEVPTAHWKTSRSACDTPYSRASPIPEQEVCTAHWKTSRSACDTPYSRNSPSNIFGLDSAASRNYMLDNNFFRPAASAQFYLDQAQQSFPYNNGGRISVSKDKQDVEEVEAYRASFGFSADEIVTTQTYVEIPDALDEGFSISPFGNNAPATEVDKSLFNVKVITGPKKSTEQKLSNGSPQNVVHLDIFKGTKGGDVCEDEGMVKDCHPFRKGRDEISLKPIEVRKKVGGGQSCSDAEIEYRRARSLREANGVVSWRSTLARQLQ

SEQ ID NO: 16028 - protein, 442 aa, Candida albicans
MVNLLKKLHITKSHQSNHSNSDSNSLNSNTSMDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAEVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 16029 - protein, 430 aa, Xylella fastidiosa Temecula1
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 16030 - protein, 361 aa, Triticum aestivum
  unsure (1)..(361): unsure at all Xaa locations
EFGTSFLRCWRGRENSPLEVIVINDSGGVRNASHLLKYDSMLGTFKADVKIVDNETISVDGKNIQVVSNRDPLKLPWAELGIDIVIEGTGVFVDGPGAGKHLQAGAKKVIITAPAKGADIPTYVVGVNEGDYDHDVANIISNASCTTNCLAPFAKGPLEXEFGIVKGTMTTTHSYTGDQRLLDASHRDLRRARSTLLNIQPTSTGAAKAVSLVRPQLKGXKLNGLRAPACPRPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 16031 - protein, 483 aa, Ralstonia metallidurans
MTMNKLTTAFGAPVVDNQNVQTAGPRGPALLQDVWFLEKLAHFDREVIPERRMHAKGAGAYGTFTVTHDITKYTRANLFSQVGKKTDLFLRFSSVAGERGAADAERDIRGFAIKFYTEEGNWDLVGNNTPVFFLRDPLKFPDLNHAVKRDPRTGMRSAESNWDFWTGLPEALHQVTIVMSDRGIPRTWRHMHGFGSHTYSFINANMERFWVKFHFVTQQGIQNLTDEEAAEITGQDREYHQRDLFESIERGDFPRWKLCVQIMPEAEASKVPYHPFDLTKIWPKKDYPLIEVGVLELNRNPDNFFAEVEQASFAPSTIVPGVGFSPDKMLQGRLFSYGDAARYRVGVNHHQIPVNSPKAAKYVNSYHRDGTMRVDGNRGAAIGYEPNTKGEWAEQPDFREPPLTLEGTADHWNHREDGDYFSQVGALFRLMSPTQQQALFDNTARSIKGVSKHIQQTHIKHCTAADPAYGAGVAAAIEMIEAK

SEQ ID NO: 16032 - protein, 433 aa, Pseudomonas aeruginosa UCBPP-PA14
MRAFEDGPWKDDHALRATALEEIAAAFERHADALIDLLALENGKIKPEAAFEVGMVPGKLRYYAGLARSERGTSGTPRPDVVSLVLREPMGVAGIIVPWNSPVVLMIRSLAPALAAGTTTVVKMPGQTAQTNALVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFDREEEGVALANRSEYGLAAGVWTREVARAFRVARKIRAGTVWINDWAKVYDEFEEGGYRQSGLGRLNGVAALDDFVEYKHISLTTGAA

SEQ ID NO: 16033 - protein, 480 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKRCRLDLKFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 16034 - protein, 95 aa, Gibberella zeae
TAGSWFCLDVAFYGLSLNNGTILKVIGYSTKDATNVYEFLHNTAVGNIIIVLAGAVPGYWVSVATIDTLGRKTIQLGGFIILTILFIAMGFAYNH

SEQ ID NO: 16035 - protein, 333 aa, Oryza sativa
MGYARTVKAATAAAAAVLVAFGVRMAAPAAAGFVADELPRAQAAAATWLTPPYLYLVINAIILSIAASSRFQPNRPQAASADASLVRPAPVPVPVPVVAVPAPAVTMPMEVPVVPVPEAMAPEPIPVEVTVPEVVKTAPEAEEAEENFTISRSAWTPRRRSTAEAEAEHEALSPFADLTNSREKPLVSTRFGRKPVKASPEGSSRALGVSRPRKEQTLESTWKAITEGRAPPLARHLKKSDTWETRPGRRQSGSGGGEDAPPPATAMRKAETFNEAAGGGGGGKKVRREPSLGQDELNRRVEAFINKFNMEMRLQRQESLKHYNEMISRGSVY

SEQ ID NO: 16036 - protein, 253 aa, Glycine max
  unsure (1)..(253): unsure at all Xaa locations
MSRRYDSRTTIFSPEGRLYQVEYAMEAIGNAGTAIGILSKDGVVLVGEKKVTSKLLQTSTSXSEKMYKIDDHVACAVAGIMSDANILINTPXVQAQRYTYAYQEPMPVEQLVQSLCDTKQGYTQFGGLXPFGVXSFLFAGWDKNFGFQLYTSDPSGNYGGWKAAAXIGANNQAAQSILKQDXKDDITREEAVQLALKVLSKTMDSTSLTSEKLELAEVFHLXSGKVKYQVCSPENLTKLLVKFGVTQPATDTA

SEQ ID NO: 16037 - protein, 480 aa, Xylella fastidiosa Temecula1
MSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTLNAVLVVVKIIALSVFVVIALPHFDMAHLKPFMPYGFIKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAVLVATAAGLVPLGEIAALANAGTLTAFIAVALCLLVLRVREPQRVRAFRTPLAWVVGPIAIAGCLYLFWSLPKMTQYLFLLWNALGLCVYLVYGRHTSLLSKAVSIDTPR

SEQ ID NO: 16038 - protein, 135 aa, Haemophilus influenzae
EDPTPALEGADVVLISAGVARKPGMDRSDLFNINAGIVRGLIEKVATTCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 16039 - protein, 809 aa, Oryza sativa
ISFHAQYSPHFSPLAFGPEQAFYSTAESVRDHLVQRWNETYLHFHKTDPKQTYYLSMEYLQGRALTNAVGNLGITGAYAEAVKKFGYELEALVGQEKDAALGNGGLGRLASCFLDSMATLNLPAWGYGLRYRYGLFKQCITKEGQEEIAEDWLEKFSPWEIVRHDIVYPIRFFGHVEILPDGSRKWVGGEVLNALAYDVPIPGYKTKNAISLRLWDAKASAEDFNLFQFNDGQYESAAQLHARAQQICAVLYPGDATEEGKLLRLKQQYFLCSASLQDIFFRFKERKADRVSGKWSEFPAKVAVQLNDTHPTLAIPELMRLLMDVEGLGWDEAWDITNKTIAYTNHTVLPEALEKWSQIVMRKLLPRHMEIIEEIDKRFKEMVISTRKEMEGKIDSMRILDNSNPQKPVVRMANLCVVSAHTVNGVAELHSNILKEELFADYLSIWPNKFQNKTNGITPRRWLRFCNPELSEIVTKWLKTDQWTSNLDLLTGLRKFADDEKLHAEWASAKLASKKRLAKHVLDVTGVTIDPNSLFDIQIKRIHEYKRQLLNILGAVYRYKKLKGMSAEERQKVTPRTVMIGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGQENFFLFGAKADQVAGLRKDRENGLFKPDPRFEEAKQLIRSGAFGTYDYAPLLDSLEGNSGFGRGDYFLVGYDFPSYIDAQAQVDEAYKDKKKWIKMSILNTAGSGKFSSDRTIAQYAKEIWGITASPVS

SEQ ID NO: 16040 - protein, 157 aa, Zea mays
  unsure (1)..(157): unsure at all Xaa locations
KXRAPSSHDTTXTTTNAGXXXXNDNEAXTGGXRXPNPXEDNHRGGEXXHXARERXPERXXHARGAPAKGXXEXTHDXTXXTXADXRRAPGXRTPENXRHTTENHERGTPETSRDPSGXAGKXNTREGNRDQEGNKQPGENNPNRNKEPEGNHTKKPN

SEQ ID NO: 16041 - protein, 414 aa, Zea mays
  unsure (1)..(414): unsure at all Xaa locations
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADXDDNDTLDSVEQRCIVNVCQPGSNLLAAGYCMYSSSVIFVLTVGTGVYVFTLDPMYGEFLLTQEKVHIPKAGKIYAFNEGNYALWDDXKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 16042 - protein, 185 aa, Glycine max
  unsure (1)..(185): unsure at all Xaa locations
MQTSLLRELVVGTPVISATYDRPQKSVNRYLPGPATQCQYSTTTSKQMRLRTNISETVKRKLSLGARILXVEEGERLLKVSQCYLSTTSGPGPLAGFLFISTDKVAFCSERSMKVFTXKGHMLRIRYKVAIPLNKIKCVNQSQNVQKPTQKYIEIVTEDNFDFWFMGVLKYQKTFKYLEQAVSQA

SEQ ID NO: 16043 - protein, 295 aa, Streptomyces virginiae
METWVLSERDVTRAVESVGRDALMDRVIDRLTEGLAEVGRGAARSPAARGFNREKPVPGIWEWMPHRESGDSITLKAVGYSPANPGRFGLPTIIGTVARFDDTTGSLTALIDGVLLTAIRTGAASAFASRLLAAPDSRVVGLIGSGAQSVTQLHALTRVFPVERVLTWDADPSHAASLADRVAFLGLDVQVAEPHRIAAEADIICTATTVPVGGGPVLPADAVFRPHLHINAIGRDLVGKTELPLDLLRRAHVSPDHPEQARHEGECQQLEPHEIGLSLGELCADPRPPTLCAAD

SEQ ID NO: 16044 - protein, 413 aa, Salmonella typhimurium LT2
MFMEFSAGLMPLETALTQMLSRITPLTAVETLPLVNCFGRILATDIVSPLDVPGFDNSAMDGYAVRVADLSADKPLPVAGKAFAGQPYQGEWPAGTCIRIMTGAPVPAGCEAVVMQEQTEQTDDGVRFTADVRCGQNIRRRGEDIRQDAVVFPAGTRLTTAELPVLASLGIADAQVVRKVRVALFSTGDELQLPGQPLEAGQIYDTNRLTIHLMLQQLGCEVINLGIIPDDPGKLRAAFIDADSQADVVISSGGVSVGEADYTKTILEELGEIAFWKLAIKPGKPFAFGKLSNSWFCGLPGNPVSAALTFYQLVQPLLAKLGGNTASAVPPRQRVRTASRLKKTPGRLDFQRGILQRSANGELEVTTTGHQGSHIFSSFSLGNCFIVLERERGNVEPGEWVEVEPFNALFGGL

SEQ ID NO: 16045 - protein, 236 aa, Haemophilus somnus 129PT
MSKLSLIQQLKQQKLSVGILSANWLQLNEEVTTLLENQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWLVSGSALFSGELKTNLKVWKSSIM

SEQ ID NO: 16046 - protein, 426 aa, Zea mays
MAARAADENRRPGVGRPAPCVRDMGSRRALTDIKNLVGVAPNPCAVAKKPVLQKSRKDEKKTALPSSRPMTRKFVASLASKEQPKCQPTGADPEPGVDQRKEPIVDGTVDIDVELGEPVDDSDGDIDMGDETENKDIMNQDESLMDIDSADSGNPLAATEYVEELYKFYRENEAKSCVNPDYMSSQQDINAKMRAILIDWLIEVHYKFELMDETLFLTVNVIDRFLEKEVVPRKKLQLVGITALLLACKYEEVSVPVVEDLVLISDRAYTKGQILEMEKLILNTLQFNMSVPTPYVFMKRFLKAADADKQFELVSFFMLELCLVEYQMLNYRPSHLAAAAVYTAQCAINRCQQWTKVCESHSRYTGDQLLECSRMMVDFHQKAGTGKLTGVHRKYSTYKFGCAAKILPAQFMLESGGTAPPPSGAI

SEQ ID NO: 16047 - protein, 335 aa, Thermotoga sp. SG1
STFVAGLERLKKGEIEPYGVTLARELPIDFKDIKIVGSYDVDRAKIGKKLSEVVRQYWKDTGSLSDDPVVSMGVHLGSVKNLPIEAEGLEDSMPLKEAVERLGDEWSKLDPDVIVNTCTTEAFKPFGNKEELLKAIENNDKERLTATQVYAYAAALYAKKRGGAAFVNVIPTYIANDPAFVELAKENNLVVFGDDGATGATPFTADVLSHLAQRNRYVKDVAQFNIGGNMDFLALTDEGKNKSKEFTKSSIVKDILGYDAPHYIKPTGYLEPLGDKKFIAIHIEYVSFNGVTNELMINGRINDSPALGGLLVDLVRLGKIALDRKEYGTVYPVNA

SEQ ID NO: 16048 - protein, 250 aa, Solanum commersonii
  unsure (1)..(250): unsure at all Xaa locations
MGRGRVQLKRIENKINRQVTFSKRRSGLLKKAHEISVLCDAEVGLIVFSTKGKLFEYATDSCMERLLERYERYSFAEKQLVPTDHTSPGSWTLENAKLKARLEVLQRNEKLYVGEDLESLNMKELQNLEHQLASALKHIRSRKNQLMHESISVLQKQDRALQEQNNQLSKKVKEREKEVEQQNQWDQQNHEINSSTFVLPQQLDSPHLGEASQNTNVVDNGEVEGGNSSQXQGAANNTVMPQWMVRHLNG

SEQ ID NO: 16049 - protein, 492 aa, Oryza sativa (japonica cultivar-group); identical to SEQ ID NO: 3105

SEQ ID NO: 16050 - protein, 584 aa, Lactobacillus plantarum WCFS1
MEMTKIKAGQALAQVLVDWNIDHIYGITADSINNTVDGFYQEKDHLKYIQVRHEEVGALAAAADAKLTGTIGVSFGSAGPGAVHLLNGLYDAKMDHVPVLALVGQSATSIMNTNFFQEMNQDPIFADVAEFHKQVTTAEQIPYVVDEAIRSAYATRSVSVVIIPDDLSGQDIKFDGFKTASLSGSQQVLMPKLDDVQQTIAALKAAQHPVLWIGKGAYNARQEVIAVSEKFSLPVLSTAPATGIMPTDHPNFMGSRGRLGTKPAFEVSQAADLVLFVGTNFPFARYLPQGIKFIQVNNNLADLGKQHDADITVLADAKEFFQALLQSEVTIKPTKFLKAAQRDKQNWNRWLKTIATDDQGGLTAEGVLEAIKDNATDDAVFGLDVGNNTEWAIRQLPLNKQQTFTMSAWYGTMGFGLPAGLAAQLNYPKKQVWSISGDGGYAMVMPDLLTEVKYHLPVINVVLENKVLGFIQHEKLLANQAPYGIDLIGADWAKMADNMGAIGFKVTNLKELKATFQKVTQLQQNGNQLPIVIDAKIKNVDPIDTSFVPVDPENFDADTIAKYRERYGIAEADQPALSQLLNEL

SEQ ID NO: 16051 - protein, 105 aa, Glycine max
MTLSKLIVASLLASLLLLHLVDADQSVIEEPQAHVQTQGSLLQKIDCNGACAARCRLSSRPRLCKRACGTCCRRCNCVPPGTAGNQEVCPCYASLTTHGGKRKCP

SEQ ID NO: 16052 - protein, 517 aa, Emericella nidulans
MKDIPAADDIQLAALGHKAELKRNFSMLSMLGLAFAILNSWTALSTSLNLSLPSGGCTSVVWGLVTAGVCNICTAASLAEFLSAWPTAGGQYHWVAAISWKRQMPMLSWVTGWANVAGWLALTATGGLLSSTLIGGIIGLVYPLFEFQRWHQFLIYIAINIIAFAINAFMNVGLPLVTKSAFIWSLTGFVVISITILSCASPDYNSGKFVFGEFINTTGWPDGVAWLLGLLQGGFGLTGFDGVAHMIEEIPNPTVLGPRIMIGCVCIGITTGLIFLIVLLFVAGDINLVIESAATPLLQIFHDATNSNAGSICLLMFPLVCTVFAATTIMTTSSRMVYAFARDGGLPASPFFSRVHPKLQVPLNGLYLTMFCVIVFGCIFLGSSSAFNAITSSSVVMLDVAYGIPIAINCLRGRQMIPERAFVLPQALGWMVNLIALAYISLTTVLFLFPPELPVTGSNMNYCVAAFGIVLIISAFQWIVDGRKHFTGPRVDAEVLAAVESYSGPNIDGAAEIREQK

SEQ ID NO: 16053 - protein, 174 aa, Glycine max
  unsure (1)..(174): unsure at all Xaa locations
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 16054 - protein, 488 aa, Vaucheria frigida
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYIAYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLETKLDINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 16055 - protein, 576 aa, Bradyrhizobium japonicum USDA 110
MHELIRDITLCILFAWMLGLLAHFSRQPLILAYLIAGFCIGPFGAGWVKSQESISVISELGLIFMLFMIGLEIDLKKIVRAGKVILFAAGGQLPGGCLLGVLFFAGIGLSLGGGHFDAVYLCIACALSSTVIIVKVLYEKRELDTLPGRITLGVLVLQDIFAILFLAVQPSLANLQVSVILLSIGRVAVLVAAALLVSRYVLPRLFHQIARRPELILLGALAWCFLVAETAERLSLSREMGALIAGVSLSTFPYALDVTAKVTTLRDFFITLFFVALGMTIPVPGLSVIGLALMIAAFTVVSRLVTTFTPLYLMKQGLRASLLPALNLAQISEFSLVVIQTGVTDNHIAAETANAASFAFVVLAVLSTFVMTRSDEIARWAIGPLKRIGLRDLDHGNGHAEEGHEGGHGEARRIVILGFFRAASALLAEIERQAPVLLEQITVVDFNPNVYQTLLSRGLHVIYGDISSADTLLHAGVGKSEMIILSVPDALLKGASNEKLVRHVRTLNPTAMIVATADLLSDVGELYEAGASYVTVTRLSDAHELFTVIEAAQAGLLADKRAELDLRLGERREVLP

SEQ ID NO: 16056 - protein, 392 aa, Prochlorococcus marinus str. MIT 9313
MKAMILAAGKGTRVQPITHVIPKPMIPILQKPVMEFLLELLKEHGFKEVMVNVSHLAEEIENYFRDGQRFGVEIAYSFEGRIEEGELIGDALGSAGGLKKIQDFQQFFDDTFVVLCGDALIDLDLSEAVKRHRAKGALASLVTKRVPKDQVSSYGVVVTDENDCVQAFQEKPSTDAALSDTINTGIYLFEPEIFEHIPSDQPFDIGSDLFPKLVEMGLPFFALPMDFEWVDIGKVPDYWRAIRSVLQGEVRQVGIPGKEVRPGIYTGLNVAANWDKINVQGPIYVGGMTRIEDGATIIGPSMIGPSCCICEGATVDNSIIFDYSRIGAGVQLVEKLVFGRYCVGKNGDHFDLQEAALDWLITDARRQDLVEPSPQQKAMAELLGTDLTPAPS

SEQ ID NO: 16057 - protein, 530 aa, Glycine max
  unsure (1)..(530): unsure at all Xaa locations
LVHHYSWDLVKAKQSPRSGRKRATPHLYSGPARLLHLGYKQELKRHLSVISNFPFAFSIISVLTXGVTTLYNPGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLLSQYTLTGCDASAHMTEETKDADRNGPKGIISAVGISIVVGWGYILGITFAVTDILYLLSEDNDTGGYAIAEVFYQAFKKRYGHGTGGIFCLVIVALAIFFCGMSSVTSNSRMAYAFXSRDGAMPLSSLWHQVNKQEVPIYAVWLSVFKSFCMALTSLGSIVAFEAMVSIATIGLYIAYALPIFFRVTLAQKHFVHGPFNLGRYGVIVGWVAVLWVVFISILFSLPVSYPITIETLNYTPVAVGCLLILVVSYWLISGRRWFRGPITNI

SEQ ID NO: 16058 - protein, 485 aa, Novosphingobium aromaticivorans
MALQLNDPSLLRQAALIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFHIGGLKI

SEQ ID NO: 16059 - protein, 358 aa, Glycine max
  unsure (1)..(358): unsure at all Xaa locations
MSPPSNLGNFKDGSESAAGENYADINWDNYELGFYLVPTDYMYVMKCAKGDKFSQGSIVPYGNIEISPSAGILNYGQGLFEGLKAYRTEDGRILLFRPDENAQRMKRGADRLCMPSPSNDQFVNAVKQIVLANKRWVPPSGKGSLYVRPLLMGTGASLGVGPAPEYTFLIYCSPVGSYHKGALNFKVEDKLYRAISGSGGTGGIKSVTNYAPVYTAMTEAKANGFSDVLFLDSATGKYIEEATACNVFVVKDNSXSLPEIDGTILPGITRKSIIEIAIDLGYQVMERAVSVEEMLGADEMFCTGTAMVVNSVASVTYKETRVDYKTGPEALSAKLRATLVGIQTGCVEDKKSWTVLVD

SEQ ID NO: 16060 - protein, 339 aa, Photobacterium profundum
MNKGKNMTIKVGINGFGRIGRLALRAAFDWEELEFVQINDVAGDAKTLGHLLEFDSIQGRWNHAVTVEGDQLLIGDASITCTQERDIDAVDWSGCDVVLEATGVHRKTSLLQKYLDQGVKRVVVSAPVKEEGVLNVVVGVNDHLFDPERHHIVTASSCTTNCIAPIVKVIHEKIGIDQASFTTIHNLTNTQTILDAPHKDLRRARSCGSSLIPTTTGSATAIVEIFPELKGKINGHAVRVPLANASLTDIIFDVSRNTTAEEINALLKEASETEMIGVLGFEDRPLVSIDYKGDQRSTIVDALSTMVVNHRMVKIYAWYDNEMGYATRTSELIRQVGSA

SEQ ID NO: 16061 - protein, 321 aa, Plectospira myriandra
SKVGINGFGRIGRLVARAAFANPNATVVAINDPFMSLDYMVYLFKYDSTHGPYQGTVEAKDGNLVIDGQVVRIFTAKNPAEIGWGEAGADYVCESTGVFTNTEACLAHVKGGAKKVIISAPPKDNTPMYVIGVNHTKYDGSAHVVSNASCTTNCLAPLAKVVHEKFGIVEGLMTTVHATTANQLTVDGPSKGGKDWRAGRGASANIIPASTGAAKAVGKVLPELNGKLTGMAFRVPVPDVSVVDLTVRLEKSATLAEIKAAIKEASENELKNILGYTEDDVVSQDFVTDKRSSIFDANACISLNDNFVKLVSWYDNEWGYS

SEQ ID NO: 16062 - protein, 315 aa, Bacteroides thetaiotaomicron VPI-5482
MKSQNPSKRNLPGVIIAYFLIYVVWGSTYFFIGVALKDFSPFLLGALRFTTAGLILLGICYLRGEQIFKKSLVKRSAVSGIVLLFVDMAVVMLAQRYLTSSLVAIIASSTALWILLLDVPMWRTNFRNPLTIAGGGIGFGGVVMLYAEQLNAEWLHPQSERGILLLVFGCISWALGTLYAKYRSSREEEVNAFAGSAWQMLFASVMFWICAVVNGDVREADLSTVSVTSWFSLLYLISFGSLLAYSAYVWLLKVRPAAEVGTHAYVNPFIAVLLGVSFGNEQVTFVQLSGLLVILLGVMLISRKRNKMKSTAISR

SEQ ID NO: 16063 - protein, 306 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPW

SEQ ID NO: 16064 - protein, 128 aa, Oryza sativa
  unsure (1)..(128): unsure at all Xaa locations
MDEEEHEVYGQEIPEDGDMDGADVDMASGGDDAAXCRSSTRXKRRRHGLRRGRRREXQELDQMKRRLKEMEEEAAALRDMQAKVAKEMQGGDPSASTAEAKEQVDARSVYVXNSSEIKPFSNRVICIW

SEQ ID NO: 16065 - protein, 583 aa, Xylella fastidiosa 9a5c
MNRSAHSATRNGASWLTHALEAEGVDTLFGYPGGTIMPFYDALVDSRLTHILVRHEQGAALAANGYARASGRVGVCVATSGPGASNLITGIADAMLDSVPMVCLTGQVASSLLGTDAFQELDVFGLTMPIVKHSFLVRSIQDLPSMVQDAFRIAREGRPGPVLIDLPKDVQMTDASHLQDHVSAAVMAPPQAEAAMIIEAAAAIASAEKPVIYGGGGIALADAVNVFRTFVDTTSIPTTLTLRGLGALPHAHPHYLGMLGMHGTRAANMAIQECDLLLVIGARFDDRATGKVNEFAPFARIVHLDADAYEINKLRNADIAVPGNLATTLTALSALLSPSTAHPHISSSRYEWQERCIGNRERFGVRYDAPGNDIYAPALLKRLSEMAPVDTIIACDVGQHQMWVAQHCKFEDPRNHLTSGGLGTMGFGLPAAMGAQFAYPERTVVLVSGDGSFMMNVQELTTIARCKLPLKIVLLDNNSLGMVRQWQELFFAERYSEIDLSDNPDFTALVQVFGIPAKRITVRSDVEQGLAYLLAQPGPALLHVQIDARANVWPLVPPNTANSTMLESNPAHVKKEAPHAIPA

SEQ ID NO: 16066 - protein, 238 aa, Oryza sativa (indica cultivar-group)
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 16067 - protein, 496 aa, Staphylococcus aureus subsp. aureus MW2
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 16068 - protein, 382 aa, Desulfovibrio desulfuricans G20
MRKTVYFIEGDGIGPEVWNAARPVIDKAVELAYGNGRSLEWKELLAGEKAYAETGTYLPQETLDTLAGAELAIKGPLGTPVGKGFRSLNVTMRQTLDLYACIRPIRYFEGIESPVKHPERVNMVVFRENTEDVYAGIEYKADTDEARKLIAFLRDELGANVDERCAVGIKPMSEKGSKRLVRRAMDFALAQGLPSVTLVHKGNIMKFTEGGFRQWGYELAHDEYAGRAVTEAQAAAGETGLVVKDRIADAMFQEVLIRPEQYSVVATSNLNGDYISDALAAQVGGLGLAPGVNMSDTLAFFEATHGTAPTIAGKDMANPGSLILCGGMLLEHLGWHEAATRIHTAMNTVIGNRTVTVDLASQMQGASTVGCRQFGELLGAAL

SEQ ID NO: 16069 - protein, 472 aa, Oryza sativa
MDLMAVLRSSASFMYYFEIAPIPLSPNCNPMNVLPRFANPIKKWDIWLVPIDDRTRLNQENQDDHFGVALEEEGAAADLVGSHDGDEGGEDVDEGGRLWSPPASSAPTAAVLKAGGATRVGEATALSLDAVLHDTCIISSNHAFLLSTSPDAALPSSSSMTVTTDAGCGAASEEGDVRVGSLSPALDQATMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGETDDDKPEKLEALISAVNSSDSSHIVHVPPGENALSDVLISTPIFTGEEGGSGFAASAAAAAATGAAGFEFDVDPNVDPELALALRLSMEEERARQEAIAKKAAEESSGAENKDHASSSNADSVMAEAEPASNAADDKKDQPK

SEQ ID NO: 16070 - protein, 201 aa, Buchnera aphidicola
MADILLLDNIDSFTYHLVDQIRKHAHNVIIYRNTVKLNYFNMPNAGKLHPVIMVSPGPGRPIHAGCMLRLIKIVKGKVPIIGICLGHQAIVEAYGGVIDYADAIFHGKVSRICHDGLEMFHNIPQHLSVARYHSLVCKKCPSYFVVNSYVDNIIMSIRHNTHRVCGFQFHPESILTPVGDQLLEQVIYWAVSKNSSHQNRV

SEQ ID NO: 16071 - protein, 238 aa, Oryza sativa (japonica cultivar-group)
MGRGKVVLQRIENKISRQVTFAKRRNGLLKKAYELSILCDAEVALVLFSHAGRLYQFSSSSNMLKTLERYQRYIYASQDAAAPTSDEMQNNYQEYVNLKAHVEILQQSQRNLLGEDLAPLATNELEQLESQVVRTLKQIRSRKTQVLLDELCDLKRKEQMLQDANRVLKRIDEIDVEAAPPQPPWNGNCSNGHGGGGGVFSSEPPQPEHFFQALGLHAVDVNQPPAPPPGGYPPEWMA

SEQ ID NO: 16072 - protein, 436 aa, Lycopersicon esculentum
MSSRLSRPFKSSPFRFVPVLSRYIVEREEPIIRPGNFGLVHPVPVNASRFGPICASFSLRLSRIQIVLLSLSKPFLDYSRGYLHIQLIDPMGAGEESTPTKTSKPPLTQHPLMPPYGTPVPYPALYPPAGVYAHPNIATPAPNSVPANPEADGKGPEGKDRNSSKKLKVCSGGKAGDNGKVTSGSGNDGATQRSDYESYFCKNSSLWIIHASDCFIFFVNSDESRSEGTSDTNDENDNNEFAANKKGSFDQMLADGASAQNNPAKENHPTSIHGNPVTMPATNLNIGMDVWNASAAGPGAIKIQQNATGPVIGHEGRMNDQWIQEERELKRQKRKQSNRESARRSRLRKQLFVKIKLEQEVMAECEELQRRVEALSHENHSLKDELQRLSEECEKLTSENNLIKEELTLLCGPDVVSKLERNDNVTRIQSNVEEAS

SEQ ID NO: 16073 - protein, 213 aa, Haemophilus somnus 2336
MSDQSCIIIAIDGASASGKSLIASTIHEELCNELGCEEIGIVTEDSYYKDQTHLSFEERIKTNYDHPNSMDRDLLIQHLCDVKKGKAVDIPVYSYVEHTRTQEVTRFEPKKVIILEGILLLTDERIRQEVNMSVFVDTPLDICFIRRLQRDMEERGRSLQSVIDQYKSTVRPMFLQFIEPSKQYADIVVPRGGKNRVAINMLKVQIQHLLNNK

SEQ ID NO: 16074 - protein, 132 aa, Brassica juncea
ILDRYGKQHAGDLKALNLQSKALSYGSHNELLELMDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 16075 - protein, 311 aa, Ralstonia metallidurans
MSIDILAYGEPLIEFNQQPDDPSRYLQGFGGDTSNFCIAAARQGATTGYITAVGADSFGERLLALWTRERVDTRHVVVNASAPTGVYFVSHDNHGHRFDYLRERSAASRYHHEQLPLATIAQARFLHLSGISLAISTSACDAGLAAMEHARKAGAKVSLDTNLRLRLWSLARARGIMREAFSLTDICLPSWDDITILTGLDDRDAIVDYLLGCGVELVALKLGEEGSYIATQESRALVAPFPVRPVDATGAGDCFGGSFIARLAADADPFDAARYANIAAALSTTGYGAVAPIPHAETVRARLEQGVTVIA

SEQ ID NO: 16076 - protein, 326 aa, Emericella nidulans
MSAAESPASDAVQETVKAAETKAVNQTAAQIRSFAAGGVGGVCAVIVGHPFDLVKVRMQTAAQGVYSGAIDVVKKTVAREGLVRGLYAGVSAPLVGVTPMFAVSFWGYDLGKTLVSNLSEVEVKNNTPQYSIAQVSAAGFFSAIPMTLITAPFERVKVLLQIQGQNPPPPGQKPKYSGGVDVVRQLYKEGGIRSVFRGSAMTLARDGPGSAAYFAAYEYIKRSLTPKDANGNATGDLSLPAVLAAGGAAGIAMWIPVFPVDTVKSRLQSAPGKPTISGTIRTVYAAGGFKAFFPGFGPALARAVPANAATFAGVELAHQFMNKLFD

SEQ ID NO: 16077 - protein, 270 aa, Escherichia coli
LLLKTQLPSGSELSLYDIAPVTPGVAVDLSHIPTAVKVKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAF

SEQ ID NO: 16078 - protein, 631 aa, Triticum aestivum
  unsure (1)..(631): unsure at all Xaa locations
SAHASGEVRLPFEENGSSKIGVSFDKPIPGGIDLGGNCEVDHGFFCSVDSLVLDGPGWEDRAKHPFDVIFEFVSEESAHGPLILFLKDVEKVCGNTYSYHGLKSKLEIFPAGVFVIGSQTQADSRKDKLNGSPFLSKFPYGQAAILDLAFQDSFALLGNSDNTAATGXLGTPKVETEFQYMINSCFDFESSKWKQLLDRDIEILKVKANISKVQSFLTRNGLECADVQTTVCVKDRTLTNECGDKIVGYALSHQVMNSTVPTPGKDVLLALSGESLQHGVDLSERMQNDHKKKSTKKSLKDVATENEFEKRLLSDVIPPDEIGVSFDDIGALENVKETLKELVMLPLQRPELFSKGQLMKPCKGILLFGPPGTGKTMLAKAVATEAGANFINISMSSIGSXKWFGEGEKYVKSSVFSLASKIAPSVIFVDEVDGMLGRRENPGEHEAMRKMKNEFMVNWDGLRTKDKERVLVLAATNRPFDLDEAVIRRLPRRLMVNLPDATNRKKIISVILAKEDLAEDVDLEAVASLTEGYSGSDLKNLCITAAHSPIREILEKEKKERSLAEAENKPLPPKYSSSDVRPLNMSDLKQAHEQVCASISSDSTNMNELVQWNELYGEGGSRKKTPLSYFM

SEQ ID NO: 16079 - protein, 143 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 16080 - protein, 753 aa, Methanosarcina acetivorans C2A
MTEEMNLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIVIKEKSIEEIKTPEGISYEDIGGLRREIQLVREMIELPMRHPELFQKLGIEPPKGVLLHGPPGTGKTMIAKAVASETDANFITISGPEIVSKYYGESEQKLREIFDEAEKDAPSIIFIDEIDSIAPKRGEVTGEMERRVVAQLLSLMDGLKSRGEVVVIAATNRPNSIDEALRRGGRFDREIEIGIPDRNGRRQILLIHTRGMPLEDEVSLGEIADVTHGFVGADLSSLCKEAAMHALRRITPEIDIEEEIPQEIIDNLVVTKEDFREALKNIEPSAMREVYVEVPHVGWDDIGGLDKAKQELIESVEWPLKYPEMFKAVNIKPPRGVLLFGPPGTGKTLLAKAVASESEANFISIKGPELLSKYVGESERAIRETFRKAKQAAPTVIFFDEIDSIAPERSSVSDTHVSERVVSQILTELDGVEELKDVIIVAATNRPDMVDPALLRPGRFDRLIYIKPPGKEGREKIFEIHTKGKPLAEDVKLSELAEMTEGYVGADIEGICREAAMLALREIVTPGTDRKSIKEKAGDVRLSKRHFERAIRRVRPTTSRETLSAYEKSAELFARYAAELEEESSEAKEEEKEIEGKEVPNFPKV

SEQ ID NO: 16081 - protein, 480 aa, Glycine max
  unsure (1)..(480): unsure at all Xaa locations
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLPMATWKVAPALAAGCAAILKPSELASVTCLELAEICKEVGLPPGVLNILTGLGPEAGAPLAAHPXDVDKIAFTGSSATGSKIMTAAAQLIKPVSLELGGKSPIIVFEDVDLDKAAEWTIFGCFWTNGQICSATSRLIVHASFESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGXCSAVISNDLERCERITKAFNAGIGGIRYSEPCVTQSPWGGIITSGDVRRLEECGG

SEQ ID NO: 16082 - protein, 523 aa, Oryza sativa
MPGGGAMVAASGAGRPEYPGGLTMFVSMACLVAATGGLIFGYDIGVSGGVTSMDPFLSRFFPSVYRAQSAAAAAAGGNQYCRFDSQLLTMFTSSLYLAALASSLGAATVTRVAGRKWSMFAGGLVFLAGCALNGAAANVAMLIVGRVLLGVGIGFANQSVPVYLSEMAPARMRGMLNNGFQMMITTGVLAANLINYGTARIAGGWGWRLSLALAAVPAAVMTAGALFLPETPNSLLERGRRGEARRMLQRVRGEGVDMEDEYNDLVAAGEASHAVASPWRDILRRRNRPPLVMAVAIPLFQQLTGINVIMFYAPVLFRTLGFGGGASLMSAVITGGVNMAATLVSVLAVDRVGRRALFLEGGAQMVASQAAVGALIGARLGWSGTAAIPAGYAAAVVAAMCVYVAAFAWSWGPLAWLVPSEVMPLEVRPAGQSITVAVNMAMTFAVAQAFLPLLCRLRFVLFFFFAGWVAAMTAFVALFVPETKGVPIEDMAAVWSDHWYWKRFVDGDGDGARRRGDIEMGHK

SEQ ID NO: 16083 - protein, 483 aa, Tortula ruralis
MTGEVKEYRLLLASKPVEADREFLDVTNKYTGEVGAKVQLATHDDVDKAIDAAVAAAPAMAALGAFERKAILEKTVAELKKRAEEIAQILTMESGKPIKDARGEVARTIDTFQVAAEESVRIYGEHMPLDISARNKGPQGIVKKFPIGPVSMVSPWNFPLNLVAHKVAPALAVGCPFVLKPASRTPLSALILGDILVPDRGAAKGAFSVLPVSRADADMFTVDERFKLLTFTGSGPVGWDMKARAGKKKVVMELGGNAPCIVDDYVPDLDYTIQRLINGGFYQGGQSCIHMQRLYVHERLYDEVKAEFLAQVKKLKVGNPFEDDTFIGPMISEKDATRVEDWVKEAVEKGGKLLCGGSRKGAVMQPTVLEDVPMDAMARKEEIFGPVVLFYKYSDFKEAVKECNNTHYGLQSGIFTKDLNKAFYAFEHMEVGGVILNDSPALRVDSQPYGGLKDSGIQREGVKYAMEDYLETKVLVMRNVGVL

SEQ ID NO: 16084 - protein, 730 aa, Cochliobolus heterostrophus
MVRSNVLTAIAAICHVAHAVCPYMDDQPLARREGATAMSTDDFMKQYEIDDSKAYLTSPVGGPQPDQESLSAGERGPSLLEDQILRRKIMSFDHERVPERAVHARGAGAHGTFKSYGDWSNITGASFLANSEKETPVFIRFSTVAGSRGSADTARDVHGFAVRFYTDEGNFDIVGNNIPVFFIQDAIKFPDLIHAVKPKPDREIPQAATAHDSAWDFFSQQPSTMHTLLWAMSGHGTIRSYRHTDGWGVHTFRFVRDDGKSKLVKFRFRSLQGKASLLWEEAQTTAGMNADMHRQDLFESIENGYYPEWIFEAQIMEESDQLRFGFDVLDPTKIVPEDIVPFTPLGKLTLNRNPRNYFAETEQIMFQPGHLVRGIDVSDDPLLQGRMFSYLDTQLNRNGGPNFEQIPINQPRVPVHNNERDGAGQMYIPLNTAAYSPNTLNGGYPKQATQAEGRGFFTAPSRSVSGNLVRTVSSTFADNWSQPRLFYNSLSAVEQQFVINAIRFETSQLQSEVVKQNVLIQLNRISHDIATRVATALGMTAPAPDDKFYHNNKTIGVNPAGEPLLKIEGLKVGYLTSAGSTGDKGKALKAALKDEKVSLTVVAEHLGAGIDQTYSATSAVNFDAIIVDGSASALFAPAGSLANSNSTAAKGRSTLYPAGRPLEILQTGYQFGKPVGVLGASNSTLSAAGVVAGTPGVYSFDSASDMAAVVTKITEGLRTFKFLDRYPLDN

SEQ ID NO: 16085 - protein, 93 aa, Zea mays
MPGSHGRPLAIDGLGRPPPVDPFQGLKCTASLPDSARSFISLGNVSNGGRILCMQVWPDYGTKKFQTLSYLPQLTTEDLLKQMDSLLCNRWIP

SEQ ID NO: 16086 - protein, 285 aa, Zea mays
  unsure (1)..(285): unsure at all Xaa locations
MEHDVDYHDHHHQQQQEDEEEAMELPPGFRFHPTDEELITHYLARKAVDPRFAPRAVGEADLNKCEPWDLPSRATMGDKEWYFFCVKDRKYPTGLKANRATESGYWKATGKDREIFRGKALVGMKKTLVFYTGRAPRGGKTGWVMHEYRLQGKHAAASSSSSLVPSSVRAGASSKQDEWVLCRVFKKSIEPPSVPGSKRSSSVACMGTEGTGVGVGPSSMSTEDDFAACAALPPLMDVSGGSGANMSLSAAAAAAFIEVTPPAGAAPAPHVTCFSXAPLEGQFLN

SEQ ID NO: 16087 - protein, 358 aa, Haloarcula marismortui
MSSDQQDDQGEEDTLVNVADGVDHQVAMVMDLNKCIGCQTCTIACKNLWTEDGGSEYMYWNNVETKPGEGYPRGWENSGGGWKSGEHKERQPGEIPDEEDYGRAWEFNHEEIMYEGSDEPLRPRDGAEWGPNWDEDQGAGEYPNSYYFYLPRICNHCTHPSCVEACPRSALYKRQEDGIVLVDQDRCRGYRYCVEGCPYKKVYYNTVSKKSEKCIFCYPRIEGEGPDGETFAPACAEECPPQLRLVGFLDDEEGPIHKLVNEYEVALPLHPEFRTQPNVYYIPPFAPGQHTEDGETVDIDRIPRQYLRDLFGDGVDQALDTIERERQRARQGEDSELMELLQDKNPAKQYRLEVFDDE

SEQ ID NO: 16088 - protein, 236 aa, Triticum aestivum
  unsure (1)..(236): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILSTGATSFXGGMKMGREVYXNLKSVIKEEXTXQDATNVXNEVVLLLNLRETKEGLELLNT

SEQ ID NO: 16089 - protein, 966 aa, Solanum tuberosum
MATANGAHLFNHYSSNSRFIHFTSRNTSSKLFLTKTSHFRRPKRCFHVNNTLSEKIHHPITEQGGESDLSSFAPDAASITSSIKYHAEFTPVFSPERFELPKAFFATAQSVRDSLLINWNATYDIYEKLNMKQAYYLSMEFLQGRALLNAIGNLELTGAFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKICYILYPGDESEEGKILRLKQQYTLCSASLQDIISRFERRSGDRIKWEEFPEKVAVQMNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHISTAGMEASGTSNMKFAMNGCIQIGTLDGANVEIREEVGEENFFLFGAQAHEIAGLRKERADGKFVPDERFEEVKEFVRSGAFGSYNYDDLIGSLEGNEGFGRADYFLVGKDFPSYIECQEKVDEAYRDQKRWTTMSILNTAGSYKFSSDRTIHEYAKDIWNIEAVEIA

SEQ ID NO: 16090 - protein, 293 aa, Zea mays
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDWHKVSEVNFHVIGHKCSHCRSYNTRTTSRPADLSGSSSPSTDSSDNNI

SEQ ID NO: 16091 - protein, 337 aa, Colletotrichum lindemuthianum
MAPIKVGINGFGRIGRIVFRNAVEHPDVEIVAVNDPFIETKYAAYMLKYDSTHGIFNGEIAQDGNDLVINGKKVKFYTERDPAVIPWKETGADYVVESTGVFTTIDKAKAHLQGGAKKVIISAPSADAPMYVMGVNEKSYDGSAVISQASCTTNCLAPLAKVINDKYTIIEGLMTTVHSYTATQKTVDGPSAKDWRGGRTAAQNIIPSSTGAPKAVGKVIPELNGKLTGMSMRVPTANVSVVDLTVRIEKGATYDEIKQAIKEAAEGPLKGVLAYTEDDFVSTDMIGNPNSSIFDAKAGISLNNNFVKLVSWYDNEWGYSRRVLDLLAHVAKVDASK

SEQ ID NO: 16092 - protein, 355 aa, Nitella opaca
LELRDGGKDFMGKGVLKAVSNVNDVIAPALIGKDPTEQTALDNFMVEELDGTQNEWGWCKQRLGANAILAVSLAVCKAGAGAKKIPLYQHIANLSGNTKLVLPVPSFNIINGGSHAGNKLAMQEFMILPTGASSFKEAMKMGSEVYHHLKSIIKKKYGQDATNVGDEGGFAPNIQDNKEGLELIKAAIEKAGYTGKVTIGMDVAASEFYDEKTKMYDLDFKTENNDGSKRISGDEIIQLYKSFCDEYPLVSIEDPFDQDDWEHYAKFTALIGEKVQIVGDDLLVTNPKRVAKAVAEKSANALLLKVNQIGSVTESIEAVRMSKKAGWGVMTSHRSGETEDTFIADLAVGLATGQI

SEQ ID NO: 16093 - protein, 354 aa, Bacillus cereus ATCC 14579
MEKRIVCLAGDGVGPEVMESAKEVLHMVERLYGHHFHLQDEYFGGVAIDLTGQPLPQRTLAACLASDAVLLGAVGGPRWDSAKERPEKGLLALRKGLGVFANVRPVTVESATAHLSPLKNADEIDFVVVRELTGGIYFSYPKERTEEVATDTLTYHRHEIERIVSYAFQLANKRKKKVTSIDKANVLESSKLWRTVTEEVALRYPNVEVEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGYAIEEAVSAVLKSGKCTADIGGTETTTSFTKAVIQEMEEQALVGRGR

SEQ ID NO: 16094 - protein, 100 aa, Glycine max
  unsure (1)..(100): unsure at all Xaa locations
KKAQMVVQVEAVRVQKELAAAEFDGYCEGELVKVTLSXTRPPTRPGNSIAASXLGPEKLSLLITEAYKDAHQKSVQAMKERMNDLAQSLGMPPGLSEGLK

SEQ ID NO: 16095 - protein, 372 aa, Zea mays
MDSSGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 16096 - protein, 263 aa, Glycine max
MATFSKERENFVYVAKLAEQAERYDEMVEAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 16097 - protein, 79 aa, Glycine max
  unsure (1)..(79): unsure at all Xaa locations
ILIILGCNFPNLCRVQARLRQPIKTDPIRPEYHRASVIWTDNDGSGNPGFVAVSTGHQVSSRLLSXKSANALXEFPATG

SEQ ID NO: 16098 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCEGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 16099 - protein, 390 aa, Nostoc sp. PCC 7120
MQFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQDAGIRYA

SEQ ID NO: 16100 - protein, 296 aa, Yersinia pestis CO92
MLKQNRRNLWLLIGSLFTLYFVWGSTYLVIRIGVESWPPLMMAGLRYLIAGVLLFSFLAIRGHALPTLRQWAAASAIGILLLAIGNGLVTIAEHQHVPSGIAAVMVATVPLFTLCFSLLWGMRNTKLEWAGIALGLVGIILLNTGSNLLGNPVGAMLILLASASWAFGSVWSSRLALPAGAMSGAAQMLVAGVVLLLASTLSGEELQQPPTMSGILALLYLIVFGSMLAISAYMFLLKNVRPAVATSYAYVNPVVAVLLGIGFAGESLSPTEWGALAVIVSAVVLVTLGKFLFARR

SEQ ID NO: 16101 - protein, 913 aa, Pseudomonas syringae pv. syringae B728a
MNNLNQPITSTARTLALSAFKQTLGLSLLTFSVMQANLALAAVTPATGNEVEARVSSILDNMNQSEKINFTRVNDGHMIPSLLKWGIKGTVAYDSSMGVHVNNATFGAQYPSQSALAATWSINRAKEFGLAIAYETRISGGQQMLSPGVNLYRTPYNGRSAEYVSGEDPFLGAVLAPAIVNGIQAQGIQASGKHYLANEQEANRQAIDVKVDERTLRELYLPGFESMVKNANVASIMCGFNKVNGDYACENHHLITEVLKGEWGYQGMVISDFNAIHDAFKGAWAGTDIDMPSGLQFTEANLLPYLWSGQLTQNVIDDKVKRNLRGIVSYDLQNHLNTAKTLEHPEYGMRAALNTARESIVLLRNENTAAGKPLLPLERSAKIAVIGNWAHDVPASPFGTANSPPNSYVTELSGLQQLASSSSDVTYLSEMSLNPASSVWYQPATGDNGISNAGVKAEYFSNTSFSGDPVLTRVEPGVNLNWTTGSNVTNAGSTAVSGFSPTAGAFSARFTTTIKPTISGAQAFKVRADGPYKLWVNDELIVQSDGVPYSGDVVNALTTSGKTAALSAGKTYTVKLEYQRVQGNFIPALGGLTGVQMSWASLRPPKDLSKYDAVVVATGTTSENEGEGSDHGFDLPDQQAELISFVAKANPNTIVVMHGGGVANMQPWANKVGATLQAWFPGQQGGQALAEILYGKVNPSGKLPVTIDKNIEDNPSYASYPDPAAYRGSNPLTEMTYSEGLYMGYRGYDKKHAKPLYPFGYGLSYTTFSYSDLKLSTNVLTPGSTIDVKFTVTNTGDKAGFEVAQLYVQPVKPAVDRPEKELKGFTKVYLQPGESKTVSVPIDSRSLAYYVDKTASWDVDAGKFKILVGADSENLTLNRTLITLYPEKLTTRDSNPLPLPLRKAVQVSAAQTY

SEQ ID NO: 16102 - protein, 480 aa, Microbulbifer degradans 2-40
MSTHTVDDEVDSLEPDNNQKILSTKLSRALKTTGMAAKSGIRHLNYLKNKTLTSSANVEKKAQLKLDHEAEIGRILFSGLSQMRGTALKASQLLSLEADLLPEGIRKELAKSCYQVPPINRALIRKMFIQELGKEPSKVFDKFEPQACAAASLGQVHKASITLPETGEQQTVAVKIQYPGIGESIDSDLKMLSFILNSLSKTTSHVPNKHVLETTLDEIERCLKDEINYEQEAENTRWFAHNLNVAGVRIPKVYNAFSTQRVICTEFLEGLHVEEWLSTNPTQAQRNRAGQIIFNIFTHGAFELNALHADPHMGNYLFLANGDIGLIDFGCVKKLDKAFTENMGHLVSAILNKNQPQVFESYKQLRILSQDMEYDRYINHVYPILGPLQDWMSTPYAPTRKDINGNTLSGPTESNYYDFSQLPPPPTDMNRANHKTAMESLYSLTRDQLYFDRSYFGVYQLLRKMKAVVDTSNKWIKASK

SEQ ID NO: 16103 - protein, 651 aa, Burkholderia fungorum
MRTRGRDRANRAQRHPRKRHAACSRLYDRQRLRDSRLPRKLLPPQPAREESRRRHGARPLVRRRSGYRRRHATGVAHVRERHASATRQYARPRHRYPGADRIPEQLHDPRARRRNPDRYARGHRQCQCGRRSGLRNRRSWPSRQYDWIGRGLRPRLIDCLTGDNKPMRIDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 16104 - protein, 337 aa, Triticum aestivum
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 16105 - protein, 424 aa, Blastocladiella emersonii
TLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 16106 - protein, 97 aa, Oryza sativa
  unsure (1)..(97): unsure at all Xaa locations
NEFESKHDGVISTGTSDDGKIVLDIIEAIHAAERKQADADAYMYSEEKRKLKEKYEKELKXPGLGSSCMLKRQQXSDKELKKEKLKSAAVIKELQEN

SEQ ID NO: 16107 - protein, 379 aa, Oryza sativa
  unsure (1)..(379): unsure at all Xaa locations
MAAEAAPEWVEKGDNAWPLAAATLVGLQSVPRLVILYGDCGAVKNLVRLRRGARSSAGAPGPSACRSATSSHPFVGRPDLSGLDQAGFLSRRGFAGAYHDXLFDRRHAWLECDGDGAMHHGQVGPRTEKDREAFPPNNVLLTLAGAGLLLWMGWTGFNGGAPYAANVDASVTVVNTHLCTATSLLVWLLLDSFVFGRLSVISAVQGMITGLVCVTPAARLVLHKRSRLLARVDDTLAVLHTHGVAGSLSGVLTGLLLLAEPRFARLFFGDDPRYVGLAYAVRDGRAGSGLRQVGVQLAGIAFVVALNVAVTSAVCLAVRVAVPQLAGGGDAIHGEDAYAVWGDGETYEQYSVHGGGSNHGGFPMTANPVASKADEMIWI

SEQ ID NO: 16108 - protein, 295 aa, Acinetobacter sp. M-1
MNAKLKKLFQQKVDGKTIIVTGASSGIGLTVSKYLAQAGAHVLLLARTKEKLDEVKAEIEAEGGKATVFPCDLNDMESIDAVSKEILAAVDHIDILVNNAGRSIRRAVHESVDRFHDFERTMQLNYFGAVRLVLNVLPHMMQRKDGQIINISSIGVLANATRFSAYVASKAALDAFSRCLSAEVHSHKIAITSIYMPLVRTPMIAPTKIYKYVPTLSPEEAADLIAYAIVKRPKKIATNLGRLASITYAIAPDINNILMSIGFNLFPSSTASVGEQEKLNLIQRAYARLFPGEHW

SEQ ID NO: 16109 - protein, 465 aa, Pterocladiella capillacea
AKMGYWDPDYSVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVLARNEGRDYVAEGPQILRDAAKTCGPLQTALDLWKDISFNYTSTDTADFVETPTANV

SEQ ID NO: 16110 - protein, 703 aa, Oryza sativa
MRPNLVIVDMLSRSMHVVVLEVAAGGTRGCNFMDVAVHVLSLLVKIFQVPSLTWHIPTGHVLFPECSEVATILGSGSPPPSPCRGHLATTATLPSFTVVGSRGDQRLLGVLVAHKRNRAAHVWAAVHRLSVFPGGESGRRGRSTASSEMADADGGSNLAVLDALDSARTQMYHMKAIVIAGMGFFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANFGPNSTTFVLPAELFPTRVRSTCHAISAAAGKAGAIVAAFGIQKLTYNSQVKSIKKALIILSITNMLGFFFTFLVPETMGRSLEEISGEDGNTGAGGGGAPAAANAGVGVSASDVSRDEKFPASSTEWQTSMHA

SEQ ID NO: 16111 - protein, 120 aa, Petunia axillaris
MSTSNASTSGVRKGAWTEEEDLLLRECIEKYGEGKWHLVPVRAGLNRCRKSCRLRRLNYLRPHIKRGDFSLDEVDLILRLHKLLGNRWSLIAGRLPGRTANDVKNYWNTDLRKKLIAPHD

SEQ ID NO: 16112 - protein, 541 aa, Campylobacter jejuni subsp. jejuni NCTC 11168
MDNFLEIFLITVAIAIVLNVIFKKFEIPTIIGYIAAGEIISEIYHLSGKGEITHIAEFGIVFLMFTIGLEFSFKHLMAMKQEVFLNGSLQMLTCGFVFMLLAIGILGLGDKSATIVGFALALSSTAVVLKILNDNGDINEQYGRKALGILLFQDIAVIPLLLLVDIFSSNNQNIEKLLFTSLISALILITLLFFIGKYLVDRIFRLIIHTSSQEIFISTVLFMVIGASFLANYFGFSYSLGAFIAGALIAETKYKHKIEADLIPFRDLLLGLFFITVGMQIQLDVVAQNWFLIIVLTLLVMALKFGIVFGFLFLYTKKRVALKTAFAIAQIGEFALAIFSLLQAKNMLDIKTSQILIVVSILTMIITPFILNNIRKITNVVEDIALNTNAVQNIDSNIKLKNHLVVFGYGRLGQEVVQKIKNTGVPYLVLESDLNLVELGVSRGENVVFANAAQEETLKIANIEECAVAIITVTNEAKLEILCQVLANYPKPIDTIIHVNGTLKKMLFSSIDENIRIIRSEKVIARNLVQEALECRIHKNT

SEQ ID NO: 16113 - protein, 303 aa, Eremothecium gossypii
MTSTSHIRFKQLERLGNGTYATVYKGLNKTTGLYVALKEVKLDSEEGTPSTAIREISLMKELKHENIVRLYDVIHTENKLTLVFEFMDNDLKKFMDSRLDREMPRGLELSLVKYFQWQLLQGVAFCHENRILHRDLKPQNLLINNKGQLKLGDFGLARAFGIPVNTFSSEVVTLWYRAPDVLMGSRTYCTSIDIWSCGCILAEMIMGKALFPGTNDDEQLKLIFETMGTPTEQTWVGVSQLPKYNPQIPLYPNKDIKQLLQATTKEQISDVLVNLIQGLLQLNPSMRLSAQQALSHPLFEEYH

SEQ ID NO: 16114 - protein, 310 aa, Oryza sativa
MKGGVIRSGGGVGGIGVGGGGGGGGAGGGLMRTRLRLPVVLLSCSLFFLAGFFGSILFTQDPQGEEELDTPMRRERLMEAAWPGMAYGESGEPEPSLIPYQILSWQPRALYFPQFATSQQCENIVKTAKQRLMPSTLALRKGETEESTKGIRTSSGTFLSSDEDPTGTLAEVEKKIAKATMIPRHHGEPFNILRYEIGQRYASHYDAFDPAQYGPQKSQRVASFLLYLTDVEEGGETMFPYENGENMDIGYDYEKCIGLKVKPRKGDGLLFYSLMVNGTIDPTSLHGSCPVIKGEKWVATKWIRDKSKAV

SEQ ID NO: 16115 - protein, 270 aa, Triticum aestivum
MDSVESFQFFQIILENSWTRLRLPDKFTRVLLELDGGKPQEVKLRNAGHGRRFWDVKVVLDADGHMYLGRGWEQFARAYDLRLGYFLVFSFDGDAVLTVKVFDVSMCRRHYQHDDDGSTSSGSSSDGDSGSEDGSSNGDGGGNSSSMAVMGIDDGPASLFTVMLRECNLGVRQKQYLNVPVEFQNAHGYAERSKVELRMRGKSWFVNLKHSPRSRGRPRASLRYGWHQFCVDNGLGVGDTCFFRALGEGSAGEVHLLKVEVRKRDGSFLV

SEQ ID NO: 16116 - protein, 294 aa, Escherichia vulneris
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 16117 - protein, 131 aa, Triticum aestivum
  unsure (1)..(131): unsure at all Xaa locations
MAPTVMASSGTSVAPFQGLKSTAXLPVSRRSNXASLGSVSNGGRIRCMQVWPIEGIKKFETLSYLPPLSTEALLKQVDYLIRSKWVPCLEFSKVGFIFREHNASPGYYDGRYWXTMWKLAMFGCTDATQSD

SEQ ID NO: 16118 - protein, 310 aa, Erwinia chrysanthemi
MTTKNIAIIGECMIELSRKARISIRGFGGDTLNTAVYISRQVKPDALDVHYVTALGTDSFSSEMMASWQKEGVKTDLIQRLDNKLPGLYFIETDATGERTFYYWRNDAAARYWLESPDADTISQQLAQFDYIYLSGISLAILNQASRARLLTVLRACRANGGKVIFDNNYRPRLWQSKEETRQAYSDMLACTDIAFLTLDDEDMLWGELPVDEVLKRTHGAGVMEVVIKRGADACLVSIQGEALLEVPAIKLPKEKVVDTTAAGDSFSAGYLSVRLNGGSAQDAAKRGHLTASTVIQYRGAIIPLEAMPA

SEQ ID NO: 16119 - protein, 601 aa, Actinobacillus pleuropneumoniae serovar 1 str. 4074
MAAEGASQLTSVVALLGAAIIAVPIFKRIGLGSVLGYLAGGLAIGPFGFGLFTDSHTILHIAELGVVMFLFLVGLEMQPAHLWGLRKYIFGLGSFQVVGASIALTGLVMAFGYSWQVAFVSAAGFVLTSTAIVMQVLSERGEMTSERGRKMVSILLFEDMLIVPLLAVVAFLSPIHSTEASTPIWQKIAIAVLAMVFLFIIGTKMLNPFFKILARTKIREMMTAVALFVVLGSALLMEVSGLSAAMGAFAAGVLLSTSSFRHQLEVDIDPFKGLLLGLFFLAVGMSLDLNVVWDNLGLILSGVALMMLIKGGVIFLVARLSGSNKLDAHDRAIVMAQGGEFAFVLFAAAHAQKVIDDTVHANMTAIVVLSMVFTPLMIIASQKFIVPRLQKIDEIKPHDHIEEQNPIILVGLGRFGQVVNHLLQMTGYHPTIIELNPKLIAAMKKRGVKSYYGNGAHPDLLKAAGIQTAQMLIVVIDNPKQTLEIVKYARSVNPHIKIIARAYDRYHVYDLVQSGADIEVRETFDSALRTGKQALRELGLDADKVHEIGNMYFGKDRHSIKLMSEVYDPKIERFKNEEMYRTALEQDQEIMAEIQKILARE

SEQ ID NO: 16120 - protein, 359 aa, Zea mays
MALTTSTNNQALLDAQLELWHTSFAFIKSMALKSAVDLGIADAIHSHGGNATLPQIVSRAALHPSKIPCLRRLMRVLTAAGIFSAAHRSPDDGGGELVYGLTPASQLLVGGSSSLAPFMSLVLHQVYVSPFLGLGTWLQHERSDPTLFEMTHGLTAWDLNDHKPAFGELFNQGMVCDSSFVMDIVVKECGDVFRGLSSLVDVAGGLGAAALAISTAFPHVQCSVLDLPHVAANAPANTSVKYIAGDMFESIPPADAVFLKWVLHDWGDADCIKILKNCKKAIPSRDAGGKVIIVDMVVGGQSSNNKHKETQVLFDLFIMTINGAERDEHEWKKIISEAGFSDYKIIPVLGVRSIIEVYP

SEQ ID NO: 16121 - protein, 327 aa, Zea mays
MDSGSRSSGGAGFDDEDGLTTRREVSSSLQDLAVRVDWKGGSCSDGGTNQGPNTPRSKHSATEQRRRSKINDRFQILRELLPHNDQKRDKATFLLEVIEYIRFLQEKAQKYEATFPEWNQENPTMLPWSKGQIPGDSPPDPSHFVRNGSSPGSNFTGKLDDNHTSAAASGALDQAETNHVASGCYRSSETPANITNNAISQSQPQWTGPSPVDDSAVKSEMLNSQELAIDEGMISVSSTYSQELLKSLSHALQSSGVDLSQTSISVQINLGKRAGKRSAAGVSSNSKEPPPADPASSNELGGHHLTTLGASADGLPHATKRHKRGNS

SEQ ID NO: 16122 - protein, 196 aa, Magnetospirillum magnetotacticum
MFLLIDNYDSFTYNLWHYLGELGAEVVVKRNDALTVDQVLALRPQGIVISPGPCDPDRAGICLDLIKRAAGIIPLFGVCLGHQAIGQAFGGKVVRAPKPMHGKVDTITHNDTGVFKGLPSPFRATRYHSLVVERESFPDCLQVSAWAGDGLVMGLTHKELPIWGVQFHPESIETEHGHAMLRNFIDFTTTRTGQAA

SEQ ID NO: 16123 - protein, 324 aa, ASPERGILLUS NIDULANS FGSC A4
MSSSLEQLKATGTVVVCDSGDFATIDKYKPQDATTNPSLILAASKKPEYASLIDAAVEKGKKQGGSVDDQVDATLDYLLVEFGKKILDIIPGKVSTEVDARFSFDTKASVDKALHIIKLYEEAGISKDRILIKIASTWEGIQAAHILQSQHGINCNLTLMFSLVQAIAAAEAGAFLISPFVGRILDWYKAAHKRDFSKEEDPGVKSVQSIFNYYKKFGYKTIVMGASFRNVGEITELAGCDYLTISPGLLEELYNSKDAVPKKLDAASATTLDITKRSYLNDEALFRFDFNEEAMAVEKLREGISKFAADAVTLKDILKQKVQA

SEQ ID NO: 16124 - protein, 394 aa, Zea mays subsp. mays
LGAERRARLPPGEMGWPLVGGMWDFLRAYKSGKPDTFIDSFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 16125 - protein, 188 aa, Oryza sativa
LHICQVGKNYVWSEWKQELITFSQFLERMWSAGCPSNLTYLAQHPLFEQLHEDIMVPDYCYAGGGELQSLNAWFGPHGTVTPLHHDPHHNILAQVLGRKYIRLYPASISEDLYPHTETMLSNTSQVDLDNVDLKEFPRVENLDFLDCILEEGDLLYIPPKWWHYVRSLSISFSVSFWWRSTVVPSKGS

SEQ ID NO: 16126 - protein, 334 aa, Pseudomonas aeruginosa PAO1
MNNSNLAAARNLIQVVTGEWKSRCVYVATRLGLADLIESGIDSDETLAAAVGSDAERIHRLMRLLVAFEIFQGDTRDGYANTPTSHLLRDVEGSFRDMVLFYGEEFHAAWTPACEALLSGTPGFELAFGEDFYSYLKRCPDAGRRFLLAMKASNLAFHEIPRLLDFRGRSFVDVGGGSGELTKAILQAEPSARGVMLDREGSLGVARDNLSSLLAGERVSLVGGDMLQEVPSNGDIYLLSRIIGDLDEAASLRLLGNCREAMAGDGRVVVIERTISASEPSPMSVLWDVHLFMACAGRHRTTEEVVDLLGRGGFAVERIVDLPMETRMIVAARA

SEQ ID NO: 16127 - protein, 112 aa, Zea mays
  unsure (1)..(112): unsure at all Xaa locations
VCPIQTPTDDXVLPYDTGASPSTKISTRLQKQLTNLAGIKLNAILGTTMDCTXPRSVIEIHNELPFLDHIENQMESLIKKNGCNVPLLLMNSCNTLDDTHNIGDNHSNPNIQ

SEQ ID NO: 16128 - protein, 206 aa, Glycine max
  unsure (1)..(206): unsure at all Xaa locations
MGVTPKIAPSMLSSDFANLASEAQRMLHFGADWLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGAQKFMAVMMDKVXRILRIKYPXFTVAGSSVFGAPEPVQVISLLRNSVEKAQQTLIQ

SEQ ID NO: 16129 - protein, 197 aa, Triticum aestivum
MASATPVEEPAAAAAAAVAEAEPRPSGASFIRHHLRSLAAYQPILPFEVLSARLGRKPEDIIKLDANENPYGPPPEVAAALGNLKFPYVYPDPESRHLRAALAEDSGLETEHILVGCGADELIDLIMRCVLEPGDKIVDCPPTFTMYEFDASVNAALVIKVPRLPDFSLDIANIVKMVEQEKPKCIFLTSPNNPDGS

SEQ ID NO: 16130 - protein, 181 aa, Brassica napus; identical to SEQ ID NO: 9661

SEQ ID NO: 16131 - protein, 546 aa, Glycine max
GNSARGSVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFISNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 16132 - protein, 97 aa, Populus deltoides
LMAHPHYHRLLAAYANCQKVGAPPEVVARLEEACASAASMGPANTDGIGEDPALDQFMEAYCEMLTKYEQELSKPLKEAMVFLQRVECQFRALTLSS

SEQ ID NO: 16133 - protein, 371 aa, Aspergillus niger
MSGTRAYNILVLPGDGIGPEVMAEAIKVLRTFNSSSMQFHLQEELIGGISIDTHGHSVTQPVKDAAVAADAVLFAAVGGSKVDHIRRGLDGPEGGLLQVRKAMDIYANLRPCSVDVPSREIARDFSPFRQEVIEGVDFVVVRENCGGAYFGKKVEEENYAMDEWGYSTTEIQRIARLAAELALRHDPPWPVISLDKANVLASSRLWRRVVENTISVEYPQVKLVHQLADSASLIMATDPRVLNGVILADNTFGDMLSDQAGSLIGTLGVLPSASLDGLPHPGKQEKVRGLYEPTHGSAPTIAGKNIANPTAMILCVSLMFRYSFNMENEARQIEDAVRAVLDRGLRTPDLGGNSSTQEFGDAVVAALQGKY

SEQ ID NO: 16134 - protein, 365 aa, Lotus japonicus
MDFSSSNGSEDTELSQAQIHLYKHVYNFVSSMALKSAMELGIADVIHSHGKPITLPELATALNLRPSKIGVLHRFLRLLTHNGFFAKTTVSRGEGAEEETAYGLTPPSKLLVKSNSTCLAPIVKGALHPSSLDMWRSSKKWFLEDNEELTLFESATGESFWEFLNKETESDTLSMFQEAMAADSHMFKLALKECKHVFEGLGSLVDVAGGRGGVTKLIREAFPHVKCTVFDQPQVVANLTGDENLNFVGGDMFKSVPPADAVLLKWVLHDWNDELSLKILKNCKEAISGRGKEGKVIIIDISIDETSDDRELTELKLDYDLVMLTMFNGKEREKKEWEKLIYDAGFSSYKITPICGFKSLIEVFP

SEQ ID NO: 16135 - protein, 493 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLRAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGGANHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLGPNYLLLPVNAPRAPHHNNHHEGFMNFMHRDEEINYFPSRFDPVRNAERVAAVSSAPLSGRREKMVIAKENNFMQAGAAGRAFDAARQERFVVRVADMLADPRCTQEIRRIWVGYWSQADPQLGARIAAKLQGRGCL

SEQ ID NO: 16136 - protein, 275 aa, Xylella fastidiosa Dixon
MIPISFEFYPPKNDDQRAQLDRTANRLRAFAPEYVSCTFGAGGSTLSYTSETVRHLSQHHGFDAAPHLSCVGGSRQEIRELLKLYRAIGCQRIVALRGDLPSGMGHPGDLRYAADLITFIRTEHGDHFHLEIGAYPETHPQASNTLNDLHYFKAKADAGADAAITQYFYNPDAYFHFVDAVQRLGVTIPIVAGVMPISNFDQLRHFSEQCGAEIPRWITKKMQAYGDDTKSIRAFGADVVTALCERLIAGGAPGLHFYTLNLAKPSTQVLQRLGY

SEQ ID NO: 16137 - protein, 337 aa, Shewanella oneidensis MR-1
MAIKIGINGFGRMGRLALRAAWDWDEVEFVQINDPAGDAHTLAHLLEFDSVHGRWRYPVTANADAIQIQDKTIRTTRNKAIADTDWSGCDVVIEASGVMKTKALLQAYLDQGVKRVVVTAPVKEDGVLNVVMGVNHQLYDPAMHPIVTAASCTTNCLAPVVKVIHEQIGIKHGSMTTIHDITNTQTILDAPHKDLRRARACGLSLIPTTTGSATAITHIFPELKGKLNGHAVRVPLANASLTDCVFELERAVTEAEVNALLKTAAEGELKGILGYEERPLVSVDYKTDPRSSIVDALSTMVINGTQLKLYVWYDNEWGYANRTAELARLVGQLDLPR

SEQ ID NO: 16138 - protein, 416 aa, Thermobifida fusca
MARPSPCPRFWVWLWLRVRRFRHTRVLGTAASPFRRIREDRQHMSNGTTTSGLTFDIRLSTERKTPQEREAILENPGFGKVFTDHMVTIRYTADRGWHDARLEPYGPLSLDPATSVLHYAQEIFEGLKAYRHPDGSIACFRPEANAARFNSSAKRMAMPELPEELFLGAIDTLLTYDGDWVPTQADTSLYLRPFMISTDVGLGVNSPSSSYLFVLIASPSGGYFANGVKPVTVWLCEDYTRAAPGGTGAAKFGGNYAASFLAQAQAVEQGCDQVVWLDAVEHRWVEEMGGMNLFFVFGSGENARLLTPELTGTLLPGITRDSLLKLAPDLGYPVEEGRISTDEWREAAASGELTEVFACGTAAVITPVSHVKSRQGEFQIGDGTPGPITMRLREELVGLQYGTRPDSHGWIRKFGR

SEQ ID NO: 16139 - protein, 1108 aa, Saccharomyces cerevisiae
MSITNGTSRSVSAMGHPAVERYTPGHIVCVGTHKVEVVNYLAEGGFAQIYVVKFLEYLNEFDNTASVPLKIGDVACLKRVLVQDENGLNEMRNEVEVMKKLKGAPNIVQYFDSNASRRRDGVQGFEVLLLMELCPNKSLLDYMNQRLSTKLTEAEIVKIMYDVALSISQMHYLPVSLIHRDIKIENVLVDAKNNFKLADFGSTSTCFPIVTTHQDIALLTQNIYVHTTPQYRSPEMIDLYRCLPINEKSDIWALGVFLYKLLFFTTPFEMTGQFAILHSKYEFPVNKYSSKLINLIIIMLAENPNLRPNIYQVLYHLCEILNVEVPIEDKYAEGAYNFSKYTQFQNKLQNVQLQMYQLQQKKIMQNNKLSDSEENLLNDMFLSSFEISSKLPMNASDGHAAVSRIPSQNVGQELEEEKESQSDQRKSTLSEDKSSRTTSNANSSGTANNPQEINTIQSPGIEDKSIFENKTPGELYYPSVSELDTYLDKELVKQSSDPTISEQSPRLNTQSLPQRQKSTSSYSSGGRSMKSTSYGAATIGSDEALANEKTAGINKMKQHKSNNPFPKMNVAYHSTNELSNDASNFFLEEQQQGQRYQQAQNQTGTQGNTFPDESQYQSRVEQQQQQQDQPKGPANYSQRNFYTGRDRSNKPMQLGGTIAGDSGNRRVNFQNISQNYATNSQSGYLPSQNSPAIPMVRPVISMNQQQAQQIQAQQLQAQQMQAKQQMQAKQQMQVQQQLQVQQQMQIQNANNNGTYVSDRTNHTTEDMRNAQGGEPPILAGNSANEPMHSSSKNEALLIELSPLKEDAGKQSFQDTNEPQTGGIEDAGGSGTIKGSNNNRNGVLNLSLNEMDLSRDDTGAAVSSFSSSSSSASIQQAKLSGRKGSSKRNNYSTDELGDSMVSSESIDIDLDDARRGKTAERRPLHNERGHKDQARSSDASKSNQFKSKDFSSVSTRQPRQSLDLNFQEVNLSSPTLTQEHRNKNDSPAPNSHHSYRVSPHASTAITENKRHSTGHELSTRSNGKHETHRTGSKQRHDLERYRHSKDKDSNSSITISTSTPSEMRKSFARARQSLDLERVRREAMASSASSSGGSNGKRRSFFSVFRSEK

SEQ ID NO: 16140 - protein, 307 aa, Pseudomonas aeruginosa PAO1
MTSKLEQLKQYTTVVADTGDFDAIARLKPVDATTNPSLLLKAAALPRYAEHLRQATAGSGGDAGLACDRFAVAVGKDILGVIPGRISTEVDARLSFDSEATLARAHRLIELYDEQGIDRERVLIKIASTWEGIRAAEILEREGIQTNLTLLFSFAQAVACADAGVFLISPFVGRIYDWYKKSENRDYAGAEDPGVQSVSRIYRYYKANGYKTVVMGASFRNLGQIEQLAGCDRLTISPDLLQQLADAQGELPRLLLPGEGEPRQVLDESAFRWQMNEDAMATEKLAEGIRLFARDQEKLEYQLATRH

SEQ ID NO: 16141 - protein, 356 aa, Glycine max
  unsure (1)..(356): unsure at all Xaa locations
MHSKAALLSFLANKCSKIQTHTLSPMALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRXNPSADMLLKPEELNLELIRSAKVFHYGSISLIVEPCRSAHLKAMEVAKEAGCLLSYDPNLRLPLWPSPEEARKQILSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 16142 - protein, 360 aa, Azotobacter vinelandii
MSKQILVLPGDGIGPEIMAEAVKVLQLANEKYQLGFVLGYDELGGAAVDKYGVPLADETLERARAADAILLGAVGGPKWDAIDPAIRPERGLLKIRSQLGLFGNLRPALLYPQLAEASTLRPEVVAGLDILIVRELTGGIYFGAPRESRLLANGERMAYDTLPYSESEIRRIAKVGFDMARVRGKKLCSVDKANVLASSQLWRAVVEEVAKDYPDVVLSHMYVDNAAMQLVRAPKQFDVIVTDNMFGDILSDEASMLTGSIGMLPSASLDADNKGMYEPCHGSAPDIAGKGIANPLATILSVSMMLRYSFGQVEAANAIEQAVSKVLDQGLRTGDIWSEGCRKVGTAEMGDAVVAALATL

SEQ ID NO: 16143 - protein, 312 aa, Vibrio vulnificus CMCP6
MATKTADYIWFNGKMVPWAEANVHVLTHAMHYGTSVFEGVRCYNTPKGPIVFRHQEHAQRLKDSAKIYRFPIPFSVEEIMEATRETLRQNKLDNAYIRPLAFVGNVGLGVCPPTDTEMDLIIAAFPWGSYLGEEALENGVDAMVSSWNRAAPNTIPTAAKAGGNYLSSLLVGGEARRHGYAEGIALSVDGYLSEGAGENIFVIKNGVITTPPATAAILPGITRDSIMTLAREMGYEVREANIAREALYLADEVFMTGTAAEVVPVRSVDQIQVGAGKRGPITKAVQEAYFGLFNGTTEDKWGWLDYVYPEKK

SEQ ID NO: 16144 - protein, 122 aa, Thermosynechococcus elongatus BP-1
MMSYALVLAGNRLITSGALGTNAAAIRGAMRADPNLLTVILPQSLERQPRESRQQLDKVMHLVEKPENDHLPLAEASSLCNQEIIARCQQLICFAFHDSHTLLQTCELAEEQHKVVTLFYFD

SEQ ID NO: 16145 - protein, 242 aa, Triticum aestivum; identical to SEQ ID NO: 5881

SEQ ID NO: 16146 - protein, 150 aa, Fusarium culmorum
WRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVSRAQNLQSAK

SEQ ID NO: 16147 - protein, 192 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIAS

SEQ ID NO: 16148 - protein, 417 aa, Azospirillum brasilense
MERILGGMSLPDLGTFALVNDRLDRLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAESVFLPSTRETGFLPDLDALTPELLERTALFYLCTPANPQGAAADAAYLERAIGLARRYGFILAVDECYAEIYLDKPPVGALQVASGLAHDGKPWANILVFHSLSKRSSAAGLRSGFVAGDPELMSRFTRLRSYSNAGMPLPVLAASAALWRDEAHVEENRALYRAKFDAAEASLKGRYGYYRPDGGFFLWLEVGDGEEATRRLWAEGGIRVLPGAYLTRCNPGEANPGAPFIRIALVNDAETVAHACGTIARILG

SEQ ID NO: 16149 - protein, 186 aa, Zea mays
MAPSAALAPVAFRSAFSTPLASNPTRNRINIEGAFCLPCSARKRASYRSFRVYSLFGGKKDKDENGDEAPSKAGVFGNMQRLYETVKKAQMVVQVEAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 16150 - protein, 762 aa, Neurospora crassa
MSSSSVVDHSPHDSAPSPLVPTASNLILIDNYDSFTWNVYQYLVLEGAKVTVFRNDQITIDELIAKNPTQLVISPGPGHPGTDSGISRDAIRHFAGKIPIFGVCMGQQCIFDVYGGDVCFAGEILHGKTSPLRHDGKGAYAGLSQDLPVTRYHSLAGTHVTLPECLEVTSWIAKEDGSKGVIMGVRHKEYTIEGVQFHPESILSAEGRGMFRNFLHMQGGTWAENERLQKAAQAQAANTKSDAPTPKKSNILQKIYAHRKAAVDAQKQIPSLRPSDLQAAYNLSIAPPQISLVDRLRNSPFDVALCAEIKRASPSKGVFALDIDAPSQARKYALAGASVISVLTEPEWFKGSIDDLRAVRQVLNGMPNRPAVLRKEFIFDEYQILEARLAGADTVLLIVKMLEYELLERLYKYSLSLGMEPLVEVQNTEEMATAIKLGAKVIGVNNRNLESFEVDLGTTGRLRSMVPSDTFLCALSGINTHQDVLDCKRDGVNGILVGEAIMRAPDATQFIRELCAGLTGPVPKSAAEPLLVKICGTRSAEAAAEAIKAGADLVGMIMVPGTKRCVDHETALSISQAVHMSKKTGSTEVSSQASKSARDFFNINAEIIRKRGPLLVGVFMNQPLEEVLEKQHLYDLDIVQLHGDEPLEWANLIPVPVVRKFKPGQVGLATRGYHAVPLLDSGAGSGTLLDLESVKKELEKDEQVTVLLAGGLEPSNVVETVKSLGPLSERVIGVDVSSGVEEGGKQSLEKIREFVKAAKSVR

SEQ ID NO: 16151 - protein, 378 aa, Zea mays
  unsure (1)..(378): unsure at all Xaa locations
ARNSARQFNSTSLNRHIHRTYLEGGINFADGSVQVLAATQMPEEPAGWFQGTADSIRKFIWVLEDYYSHKSIDNIGGGGGDQLYRXEYMELVQKXVEDDADITISCAPVDESRASKNGLVKIDHTGRGREFFEKPXGADLNSMRVETNFLSYAIDDAQKYPYLASMGIYVFKKDALLDLLKSKYIQLHDFGSEILPRAVLDHSVQACIFTGYWEDGGTTKSFFGANLALTEQPSKFDFHDPKTPFCTAPRCLPPTQVDKCKMXXMHRXGXRKYAFITEGCXLTECNIEHSVIGVSSRVSSGCELKDSVMMGADIYETEEEAATPPPARSALRQKASGATCVQKLDGSRDSAIHTRYRILLRSSSMREPRYHAKAAFST

SEQ ID NO: 16152 - protein, 777 aa, Oryza sativa
MDEEAKPNPNADAAPAAAEAAASSPPPLSSSESAEGKDKEEEKEEEEEEEAGDLVEKLVELVEEIAAISDFRNAYRRQFCNLSRRIRLLAPMLEEAKEGPRPLPDVSYSALRRLREALADSRELLRLGVSGSKISLVGPGFVIPGCQINAGPEQLMLFSNKLVKNIISLYFSFSLVGQSEIGLNHGEVLEREKIMKSFQDITARLEQALGLISFDELDISDEVREQVELVHAQFKRAKERSDPSDDDLFNDLVSVYNSSTSANVDPDILQRLSDKLQLATISDLNQESLILHEMASGGDPGAVVEKMSMLLKRIKDFVQSRDPEMGTPVNTTELSGKDNMASLIVPDDFRCPISLDLMKDPVIVATGQTYERGCIERWLEAGHDTCPKTQQKLPNKSLTPNYVLRSLIAQWCEANGMEPPKRAAQHHNAPASCTAAEHSNVVELLQKLLSQNLEDQREAAGMLRQLAKRSPENRACIGDAGAIPILVSLLSITDVSTQEHVVTALLNLSIYEENKARIITSGAVPGVVHVLKRGSMEARENSAATLFSLSLVDENKITIGASGAIPALVLLLSNGSQRGKRDAATALFNLCIYQGNKGKAVRAGLIPVLLGLVTETESGMMDEALAILAILSSHPEGKTAISSANAIPMLVGVIRNGSARNKENAAAVLVHLCNGEQQQQHLAEAQEQGIVTLLEELAKSGTDRGKRKAIQLLERMNRFLMQQSQAQAQAEAMAQAHAHAQSQAQVQALNEAQSQVEMQVEQLLLPTTSHLSDRRDG

SEQ ID NO: 16153 - protein, 459 aa, Calyptrosphaera sphaeroidea
DPEYAIKETDLLALFRCTPQPGVDPVEAAAALAGESSTATWTVVWTDLLTACDLYRAKAYRVDPVPSAADTYFCYIAYDIDLFEEGSLANLTASIIGNIFGFKAVKALRLEDMRMPYALLKTYQGPATGLVVERERLDKFGRPLLGATVKPKLGLSGKNYGRVVFEGLKGGLDFLKDDENINSQPFMRYRERFLYSMEGVNHAAAMTGEVKGHYLNTTGATMEDMYERADFAKELGSVIVMIDLVIGYTAIQSMAKWSRKTDMILHLHRAGNSTYSRQKTHGMNFRVICKWMRMSGVDHIHAGTVVGKLEGDPLMIKGFYNTLLDFKTDVNLPQGLFFAQDWASLRKCVPVASGGIHCGQMHQLINYLGDDVVLQFGGGTIGHPDGIQAGATANRVALEAMVIARNEGRDYISEGPQILRDAAKTCGPLQTALDLWKDITFNYASTDTADFVETPTANV

SEQ ID NO: 16154 - protein, 248 aa, Rhizobium sp. NGR234
MHPMNRYEVALVTGASSGIGKAIALELASAGLRVLALGRDRAALDELHSTAGIVPVVFDLSDVSEVYGKIAGEKIDVLVNNAGLLTASASLVDLSEDDIDAMIDINIRSVFKLTRHVLKQMIERRRGHIFFTGSSGGLAPHPNSSVYGATKAAVSLFSSALRCDLIGLPIRVTELFPGRVETNLYRTALGKEGAKKKLYDDNEAIQPEHMARLLRTALELPDFVDVTRLEVMPTGQVVGGAQMSKLSR

SEQ ID NO: 16155 - protein, 340 aa, Cyanidioschyzon merolae
MAVPKVGINGLGRIGRLVLRAAVEKGTVEIVAVNDPFIFSDVSYAAYSLKYDSTHGAFPGEIGTDGEHLVINGKKITCFAIRDPADIPWASTGAEYVVESSGAFTTAEKASLHLKGGAKKVVVSAPAKDVPMFVMGVNHDSYTKDLQVVSNASCTTNCLAPLVKILDEAFGIENGLMSTIHAVTATQRTVDGPSNKDWRRGRSAMLSIIPSSTGAAKAVGKVYPKLDGKLTGMAFRIPVALVSVVDLTANLKTPTTYEEIKHVMKAAAENPEFKGIFGYTEDPIVSADLAHSSYSSVFDAQAGIMLSPTFVKLVSWYDNEWGYSNRVVDLITHMAKVDAA

SEQ ID NO: 16156 - protein, 179 aa, Oryza sativa
MSSLCQPPPCRTILVVNRAAQAAPITSPQARSTGWASSNGGERRHTRAGTPRRGGWHGTCAVMALERILADIRAQAASPTCPTRCSSTTSSASSPSQSWPRPALSTLWRPGSWRPSARHNFRVLFVCGCRDLGEALRRIREGAAIIRTKGEAPLTWPTQGRKGCGDGEKRDERAGPSVF

SEQ ID NO: 16157 - protein, 302 aa, Panicum miliaceum
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDTLGAGELSTMLGASAVSGFCASACSLPFDYVKTQIQKMQPDANGKYPYTGSLDCVMKTLKSGGPFKFYTGFPVYCVRIAPHVMLTWIFLNQIQKFEKDIGL

SEQ ID NO: 16158 - protein, 204 aa, Zea mays
MLFVFGFYWIREYDSRLPNAERSVARLPLVGLISKCLGCIFVQRESKTPDFKGVSGAVSERIHRAHQQKNAPMMLLFPEGTTTNGDYLLPFKTGAFLAKAPVQPVILRYPYKRFNAAWDSMSGARHVFLLLCQFVNYLEVVRLPVYYPSEQEKDDPKLYANNVRKLMAVEGNLILSDLGLAEKRVYHAALNGNSLARALHQNDD

SEQ ID NO: 16159 - protein, 247 aa, Oryza sativa
MGKHGKCDVEACYPGGAPGGGMYPYMIENAQLRWAFIRKVYVIVSVQLLVTVAVAGAVNLVEPIKTFFQARTPEVLVAYVIIIISPLIMMLPMIYFRNKHPINLFFLLLFTVCISFSVGLGCLSKNGTVIFQAAGMTAAIVIGLTCYTFWAAKRGYDFEFLGPFLFAATLVLFLYAIITIFLPMGRTGKLVYGCVAALIFSGFIIYDTDNLIKRYTYDEYVAAAITLYLDIINLFMALVTALQAADG

SEQ ID NO: 16160 - protein, 287 aa, Neurospora crassa
MSGPKYTPAPQEDPDAHLYYPQPPPSYQATAESSAANAVLGDQARLFSGAPRSSQDDDHDIPDDFKFGGSVAEATVEIRHQFIRKVYTILTVQLIATGAVSALSFLSDGYRNWIQSHPAMIWVSFAGALVFMLLTFWKRQSYPTNLLFLSGFTLLEAYTISVCVSFFDSTTVLLAVVITAGIFVFLTAFACQTKYDFTSWMPYLGGALWGLIITGFIYAFLPHTSTSELVYGGVAALVFSGYILVDTQLVMRKYHVEEEIAAAISLYLDILNLFLAILRILNSQSDN

SEQ ID NO: 16161 - protein, 363 aa, Ricinus communis
ASTLKSGSKEVENLKKPFMPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKL

SEQ ID NO: 16162 - protein, 498 aa, Coxiella burnetii RSA 493
MKKIYHYINGKFVDAKGETYQEVYNPATGEVSAQVAFGTAEEVEEAVESARNAFASWSSVTPLRRARVIFKFKALLDKNIDKLAELLTSEHGKILEDAKGEVLRAIELTEFSCGTPYLLKGSYSENVGTDVDSYTIRQPLGVCVGITPFNFPVMISAWMFVSAIACGNTFVLKPSEKDPSAALFLAELMQEAGLPAGVLNIINGNGATVDRLITHPKVAAVSAVGSTAAAEHIYQTAIAHGKRAHTFGGAKNHCVITPDADIDEAADAILGAAYGAAGERCMAVSVVVAITDTVGDALVQRLKEKIPQLQIAAGTESRADFGPLVTKEHLEKVKAYIHLGVEEGAELIVDGRDLETLKHKKGFFLGGCLFDHVKPSMRIYQEEIFGPVLCVTRVSNFEEALALINKNEYGNGVAIFTKSGEMARYFASKVSVGMVGINVPIPVPVAYHTFGGWKRSIFGDIHMHGAENVHFYTKQKTVTVRCWPREKTTESAYHMQSH

SEQ ID NO: 16163 - protein, 634 aa, Xylella fastidiosa 9a5c
MSTSSHSGDCTAVPSNSNGTIILSAIGVVFGDIGTSPLYTLKEAFSPNYGLTPNHDTVLGILSLIFWAMMLVVTIKYVAVIMRVDNDGEGGIMALTALTQRTMPFGSRSIYIVGILGIFGTSLFFGDGVITPAISVLSAVEGLEVAEPHMKAFVVPITLAVLILLFLCQRFGTERVGKTFGPITLLWFIAIGVVGVYNIAQAPEVLHAINPSWGLHFFLEHGWHSMFVLGAVVLAVTGGEALYADMGHFGAKAIRHAWMYVVLPMLALNYLGQGALVLSNPTAIGNPFYQSIPDWGLYPMIALATAAAVIASQALITGSYSLSSQAMQLGYIPRMNVRHTSQSTIGQIYVPTVNWTLLTLVILTVIGFGDSTSMASAYGVAVTGTMMITTVLMIIYARANPRVPRLMLWMMAIVFIAVDGAFFYANIIKFMDGAWFPLLLGVVIFTFMRTWLRGRKLLHEEMRKDGINLDNFLPGLMLAPPVKVPGTAVFLTADSTVVPHALMHNLKHNKVLHERNVFLTVKTLKIPYAANSERLKIEPISNGFYRVHIRFGFMETPDVPSALMCSKDHAGIDFDPMHTTFFVSRETVIPSANRGMPIWRDKLFVLMHRNAAPANAFFRIPGNRLVELGAQVEI

SEQ ID NO: 16164 - protein, 652 aa, Chlamydomonas reinhardtii
MADFAMPEYLWLVVVGSMAAFAFGWGTGSNDVANAFGTSVGAKTLTLKQAVIIAIIFEFVGALVLGRVSTSTIAGGIANINVFLAEPEVYSYGMIIALTVGFVWQALASYWELNVSATHSIIGAIIGFSFVFGGANAVNWATPDSASFPPYKGVVPIVLAWFVSPVLTGLCSCILFLIVRTLVLRRENSYVLSFWVLPVMVMITTWINIYFVFTKGAKKTLSSSDDWTDAKAAWIAACCAAGLAFLTIVLVLPLLKWKADKKFRMDEEKAAGGADEEAAKAKAKAEDEAASETNSKFLKAMTSLKRAAMHGLEVDVHEVVEEDPIVAAIHKNAEVFDPKAEYAFSYLQVFSAICVIFAHGAGEVGYMAGPLATIWFTVKDGTLYSKVQAPIWIIIISALGLVIGLATYGYNVTRAVGTRMAKLSPTRGFAAELSTAIVIMVAAQYGLPTSSSQCITGGIVGLGMIEGKTGVNWMFLLRTFASWVATVVVVALTTAAIFAMGVFAPSISCNKQLYLYERYTIEQGQSIAKDVLSTLNAYKTFAYQNTTLPNLNQTKWQAMNKSINAYISNGTKFLTYKSYGSLNPQTTNSYLSAAITLMASTSITTLGQAQTYPTAKVCNDNSTLPMTFNQACKAPQPMKAIGSTYGFNITTV

SEQ ID NO: 16165 - protein, 333 aa, Escherichia coli
MSKVGINGFGRIGRLVLGRLLEVKSNIDVVAINDLTSPKILAYLLKHDSNYGPFPWSVDFTEDSLIVDGKSIAVYAEKEAKNIPWKAKGAEIIVECTGFYTSAEKSQAHLDAGAKKVLISAPAGEMKTIVYNVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKQATTNNESFGYTDEEIVSSDIIGSHFGSVFDATQTEITAVGDLQLVKTVAWYDNEYGFVTQLIRTLEKFAKL

SEQ ID NO: 16166 - protein, 396 aa, Arabidopsis thaliana
MLRDGNKQSKNNVRFVRKSIKTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 16167 - protein, 633 aa, Picea abies
MMTVDTSSIEPVGKIAPRSSEETESVCVEAAAATVTHIQSNNETRRRAPFRSEMTESGTSISSVVNSIACNENINSLEHEASSKAVELDGDVLSSNSTQVPRSNEGNHKIFGFSLKIETQNLTSRGNLLNVKANDEQQKDPACVTRHFFPLHNGQPSEVLMPTECTGGNPFTESHWTTVTSRLPESTEPRKKQAENNKPIKKSRRGPRSRSSQYRGVTFYRRTGRWESHIWDCGKQVYLGGFDTAHAAARAYDRAAIKFRGVDADINFTLTDYQEDLDQTSKLSKEEFVHILRRQSTGFSRGSSKYRGVTLHKCGRWEARMGQFLGKKYIYLGLFDSEEDAARAYDKAAIRCNGKDAVTNFDPSSYENEILEEGRESQTSTGFDQNLDLSLGIGHVTTQLKISPSYKSRVEEDSQLNRIEAVTYSNLSQDSKILSCLTSKGAENAVPEFQSLPRGHAVYWNSQTLQVPDAMKHKQSHTREDNAYEQTAISGSQLYPDHLSNCKRLNMEGLKEQSLGVPSSTVSFWPMKQQSGWTWQLHASGPTTPVFTTNRSPASGFSPQIHTAFVPSTHGCHKMGVHWAAQSTDPCMVQTPSPHLATRLTSGPDSGDHPVGLTLDLPGKKIKRSSVQRDKVD

SEQ ID NO: 16168 - protein, 62 aa, Zea mays
MKYMGELGLNFEVYRNDELTIEDVKRKNPRGILISPGPGEPQDSGISLQTVLELGPTIPIFG

SEQ ID NO: 16169 - protein, 216 aa, Helleborus orientalis
IENTTNRQVTFCKHRNGLLKKAYELSVLCDAEVALIVFSSRGRLYEYSNNSVKKTIERYKKASTDSSNSGSASEANAQYYQQEAAKLRNQIAALQNSNRNLLGEQLSNLSIRELKQIEKKIETGINKIRSKKNELLFAEIEYMQKREVDLQNDNMFLRAKISENERTQQHMSLMPGTNNYEVISSGPFDSRNFLQVNLLESNNNYSRSDQTALQLG

SEQ ID NO: 16170 - protein, 516 aa, Streptomyces avermitilis MA-4680
MSERISAPGTSHARGRAGADPGALDDDATLHAMGYPRKLTRRFQAFDNFAISFTIINIISGIFSSFGFGMNAGGPRILVFGWIGVSVMVLFIGAAMAEVASAYPTSGALYFSAGKLAKRHKGAWSWYTGWLNFVGQVGGTAATGYAAATFIQAFIALQWSSYEPTAHQTVLITALIIALQGLANTYTVQLVAVLNRISVWWLLIGLVVIVSTLTVMPDDHQSASFVTHFANNTGFTNGIYGGMLGLLVTSWTFTGFDGSFHMSEETVRATVNAPKGITRAIGYSAITGLILMLALVYSIHDYDQVAGSSAPPVQILIDGLGMGTAKVLLLIVIGAMLFCGLANLTSNTRQIFAFSRDGAMPGSRWWHTVSPRTRTPVKAVWLAVGCSLALVLPGWWSHTAFTAIVSVNVVGLFLAYAVPIFLRLRLGDEFRAGPWNLGRWSRPVGILAVTWILLSSVLFMLPQASPITVDSFNYAPIALAVVLVVATVWWFATARRRFQGPVSYGRPDEVAAMDLV

SEQ ID NO: 16171 - protein, 439 aa, Thermobifida fusca
MLDTGTTAWLLMSAALVMLMTPGLAFFYGGMARAKSVLNMMLMSFTSIAIVSVLWVLVGYSLTYSPGYGPLTHLIGGLGDFGSSGFVNAVDEEGGYPLLVDVGFQMMFAIITVALISGAIADRAKFGAWLLFVPLWSLFVYFPVARWVWGGGWFDQLADWFGASVVDFAGGTAVHINAGAAALALTFVLGRRKGFGSESMRPHNLPFVLLGAALLWFGWFGFNAGSAYGANETASLALVNTQVCTAAATAAWMLVERVRYGKVTALGFASGAVAGLVAITPAAANLTPVWAVVLGLVAGAVCAYAISWKFKFKYDDALDVVGIHMVGGIIGSLALGVFASATVGEGAPDGILFGGSPMFLLVQFIAVAATTLYSFAVTWLIAKAIDMAMGFRLPEHVETNGLDTELHAQSAYAFDELDTVELSSSLPPGEEKPSAQVRV

SEQ ID NO: 16172 - protein, 157 aa, Triticum aestivum
  unsure (1)..(157): unsure at all Xaa locations
AKKAAEEXSNTENNNASSSNSDSVMAEAEPASNAAAGDKKEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDKSDKTEDEKN

SEQ ID NO: 16173 - protein, 538 aa, Lycopersicon esculentum
MANDLQVLNALDVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAISEAKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGIGVRNSLIVLGCVNFLGMLFTFLVPESNGKSLEDLSRENEGEEETVAEIRATSGRTVPV

SEQ ID NO: 16174 - protein, 623 aa, Zea mays
MLRRCMRDLRSPRSLARVSRPISGESPTFLKSRSNSTKASPKSSQNAAPGPQGQPSQSGSNVSKIVLGTLVVGAAAMGAHQLGYIDLQFRDKKFPFSLKKEDVVKVYEDLKIPSEQKVDQTQNVSGQNTEIVQENNNEAHTPKGVLNDGMGALEVPINEDQLVPAEEKKSQTLAHETHPVPDEHGSDTKMPSEDSLAVEIETVPIDANESSEVPHEQQTDRIDSTIPPTQSTPTTVSTYDHPTDPDAPKDLSGAGAVEQKSLAETYFLQDEPDVSKDATIKEKRSDEVIREKTSKDGKIVLDIIEAIHAAEKKQADVDAYMYSEERRKLKEKYEKELKDTRARELMYAEEAAILDKELKKEKLKNAAALKELQEKAEQKLQDELQRKDEETSQQIEKAQEIAKAELAAAVAKEKASQIEQIAEANLNIDALCMAFYARSEETRQSHSVHKLALGTLALEHALSSGSPIRSEVELLRKSVEGIDKDSLLELALSSLPEDVLDYGSDTMMGLKQKFNSLKETIRHFSLLPAGGGGILAHTVARVASSIKIKGDNSGDGIESLINKVERLIVDGDLITAADALEQGLHGTEAEEIATEWVKQARKRAIAEQTLALLQACASSTTFS

SEQ ID NO: 16175 - protein, 99 aa, Zea mays; identical to SEQ ID NO: 3237

SEQ ID NO: 16176 - protein, 374 aa, Zea mays
  unsure (1)..(374): unsure at all Xaa locations
MSAPLLPLAAWLACLCLCIDQVGTSGGGPRRAPTEAKLKVAINGFGRIGRNFLRCWHGRGDDSPLDVIAINDTGGXVKQASHLLKYDSTLGIFDADVEPVGDNAISVDGKVIKVVSDRNPSNLPWGELGVDLVIEGTGIFIDREGXGQAGAKKVLITAPGKGDIPTYVVGINADQYNPDEPIISNASCTTNCLTPFVKVLDQKFGIIKGTMTTTHSYTGGQRLLDASHRDLRRARAAALNIVPTSTGAAKAVVLVLPNLNGKLNGITLRVPTPNVSVVDLVVQVSRKTLAEEVNQAFRDAAANELQGILEVCDVPLVSVDFRCSDVSSTIDASLTIVMGDDMVKVISWYDNEWGYSESXQRVIDLADICANQWK

SEQ ID NO: 16177 - protein, 526 aa, Yarrowia lipolytica
MIQSVFLALAILIAYLGFAEWFSRFQHRRISKKKGCGMPPMANGGFLGWYGLYKTYQITSERTYPHSMRMGLEAFGHTFVYPVPGTDMLQTIHPDNIKAILATQFKDFSLGTRHKIMLPTLGDGIFTLDGEGWTHSRALLRPQFARDQVSHVASLERHIQVLFKTIKKENKECDPAKGFDIQELFFMLTLDTATEFLCGDSVDSLTDYLADPTAPQLDHSGIDENVRRAFPEAFNTAQWFCSIRAKLMKLYFFAGTVFYRKKYADANKIVHDFTDFYVSKALAARKEKFQELDQEGKYIFLYELAKETRNPKVLRDQMLNILLAGRDTTASLLSWVMFRMARQPETWKKLRQAVINDFGDTPDELSFESLKRCEYLRYVLNEGLRLYPSVPMNFRVATRDTTLPKGGGPDLDQPIFIPKGGIVVYSVYHTHRAEEYWGKDTEEFIPERWDPAEGYQIARGWEYLPFNGGPRICLGQQFALTEAGYVLARLAQEFETVTSCDDKPLPPKYNTHLTMSHDDGVWLKME

SEQ ID NO: 16178 - protein, 417 aa, Oryza sativa
  unsure (1)..(417): unsure at all Xaa locations
RGGRKKKKKKKKKKKKKKKKKKKKKKKKLGKGVSKAVDNGNSVIAPALIGKDPTSQAELDNFMVQQLDGTKNEGGGGKQKLGANAILAGSLAICKVGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASXFYNDKAKPYGLXLSRRRNNAWFHKRISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 16179 - protein, 343 aa, Methanothermobacter thermautotrophicus str. Delta H
MLSYPGELQGCRVILYLVGHHLYLIPTTISMCGCPEEGAYMRRLWGYISIITATIFFGISATLDKIMLSSMHPVTIGAYTYIIAGIFLFFIRETPLREHVLNAINRKGESEARIKRNDYLILLLTALLSTVIAPLLFLTGLGDTTAVNASLILNVEVLFIILLGYLIFRETLQLKDFLGIVLIILGAVYLLTEGDFSTILRNVAVTGNFLVMAAAFFWSLDTVLSKFLSRKRDLIFISGVKSSVGGFVLLIIMLILGINTELPLEMLPYALGVSVFSIGCSFILIYIAIREIGASMVGALFPLSSLFGAIFAFIILREPFSIMQGISGIVMLTGVFILYWNGK

SEQ ID NO: 16180 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLASETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 16181 - protein, 301 aa, Clostridium tetani E88
MKDVKKAHFLAIILMILWGMSYLSIKVVVHEIHPVLSAFYRFLIAAIILFIYLKVRYPEEKVLKEDKIKMALGGFFGVAMYFLFENYAVYFTTASNVAIIISSIPIFTLISQRIIFKEKINVVKAIGASLSIIGIGIILLSKGKVSLFSKGTIGDLMGIGAALCWVAYTVVISKLKGNYRSIVITTYQTIWGCIFLSPSIFIFQHSIMPSTKAIANLLYLSFFCTCIGYAIYIYCQNKLGATVITTYINLQPIVSIISAKILLNENINSKQILGSAIIIIGLFLASKSEKINKQIIEALKG

SEQ ID NO: 16182 - protein, 427 aa, Corynebacterium glutamicum
MRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 16183 - protein, 116 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPVSVLCRPADGRSGRD

SEQ ID NO: 16184 - protein, 545 aa, Eremothecium gossypii
MGIQVSDQIAIALKQHGIEVVFGIVGIPIVELAEKLAEHGVRFIACRNEQSCSYAASVYGYLTNKPGALLVVGGSGVVHALAGIHNAWVNKWPLLVIAGSTEDEYKGGFQELDQLRIVAPWTSFKGRLSLDNVNYMVYTAVKTAVLQHGVSYLDVPGRLINMDAVGPLASKPVDIQHVRSGPDSSRVQGAAKLLQDGRNILVVVGRGCAEYPGVVRSFLERYRLPFLPVPMAKGIVPDSHELNVNGCRSLALKRAEIVLVLGARLNWILHYGSAPKWNADATFIQVDRDPATLGHNNSSGVNYSVLSDVELFINAITAVLPQSWQYRGVDNEVLDKIRENGVKLQRKAQLTPGSPLNYHAVYSLLRKLIDDKNTILSAEGANTMDNSRLWFGTDYPKRRLDAGTGATMGLGVGYALSAKLANPDKFVVALEGDSAFGFSCMELETAVRNKVGLVVVVMNNGGIYHGNPGSGPVRTTDLSPECAYHLVGQGLGCNGVLIRTLDELKKEFPRALQNSMKSITTVLNVILEPGTQTNVSFGWQAKSNM

SEQ ID NO: 16185 - protein, 95 aa, Buchnera aphidicola
  unsure (1)..(95): unsure at all Xaa locations
ASLNDSNFGLYEPAGGSXPDIAGKNIANPIAQILSIAMLVRYTMKLPIXSDQIESAVIDTLKKGYRTLDIANDKEKCESTNDIGDIISYILKKRI

SEQ ID NO: 16186 - protein, 301 aa, Bacillus anthracis str. A2012
MTQLSRTKTAIILTFLVFMWGINWPLSKFALHYTPPVLFAGVRTLIGGFILLLFALPKYKELHLKETWHLYVISSLLNIIIFYGLQTVGLQYMPAGLFSAIVFLQPVLLGIFSWIWLEESMYGLKIFGLILGFIGVGVISSSSLTGHISIIGILLAIGCAIGWALGTVFIKKTGHRVNSIWMVTLQLIIGGLCLIGFGSEFESWSSIAWSMPFVSVLLFISFFVIAMGWLAYFTLVGAGEASKVGAYTFLIPLIAIIVSSIFLHEAITISLFIGLLFIVVSICFVNIKPKTLAVGQRVEVK

SEQ ID NO: 16187 - protein, 481 aa, Zea mays
  unsure (1)..(481): unsure at all Xaa locations
LPPRKGRKYGVVSSTSSVRCSGGERPRPLKPKQTGVGREHARPLPLVRSSRLPPGTTTHIPIARARGRVQPVLGGRARGSPLPLASPLALRPLDGALCLSPPLAXARRRRRSSGRFVAVASMTSAVSTKVENKKPFAPPREVHVQVTHSMPPHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMRKKISMPAHLMFDGQDDKLFEHFSMVAQRLGVYTARDYADILEFLVDRWKVANLTGLSGEGNKAQDYLCTLASRIRRLEERAQSRAKKAGTLPFSWVYGRDVQL

SEQ ID NO: 16188 - protein, 135 aa, Zea mays
  unsure (1)..(135): unsure at all Xaa locations
MLDLRVHLHIWWSVKGARARWRENGCKKLKVNNGIEKGSMDGALIYIENPISXRTEHMNYLRLAFQLDACGARPCTHAKRQDIRTSMRSHHTXIDSGLSTVNXHKMHRTMGICXRQRLNMKVQGKHMDGAMDDYG

SEQ ID NO: 16189 - protein, 482 aa, Chloroflexus aurantiacus
MLISENEVRAMSVGVAYTLTLRCQIENRPGMLGRLTTLIGEVGGDIGAIDIVRAERNILVRDITVRVQDEQHGEQLVAAINTLQNIKVLQVSDRVFLTHLGGKLATQSRVPLKTRDDLSLAYTPGVARVCRAIADDPEKVYALTWKGNSVAVVSDGSAILGLGNLGPEAAMPVMEGKAILFKELANIDAVPICLRSQDPDVIVQTVEQIAPSFGGINLEDIAAPNCFIVEGRLEESLDMPVMHDDQHGTAVVVLAALRNAVRIVGKRLADVRVVVNGIGAAGTAIIRTLIEAGVGEITAVDRFGILVEGDHARQTPMQRIIASQTNRERRRGDLAVALRGADVFIGVSKGNILTPDHIRVMSSDPIVFALANPIPEGDPDMLRQYARVVATGRSDQPNQINNVLSFPGIFRGALDVHARRITSAMRLAAAEALATVIPPEEMNEDYIVPSVFNRQVVPAIAAAVAQAAIAEGVARRTHMPGD

SEQ ID NO: 16190 - protein, 272 aa, Zea mays
KGPIPREIGKLSELTDLYLDVNHLTGPVPGEIAAIANLQVLQLGYNQLTGSIPPQLGNLNKLTVLAMQSNQLDGAIPATLGELTQLRRLDLSFNSLFGSIPSKIAEVPLLEVFDVRNNTLSGSVPVGLRRLNGGFQYMNNKGLCGAGFSLLELCLSSEDGLKPSKPEPFGPDGTVKTRQVPQSANPDGCSGASCSKSANASQGVLIVAVVAAVIGAAFCGLFAFSWYRRQKQKIGSSLEVSDSRLSTDHFQQKEACRRSASPLISVEYSNRV

SEQ ID NO: 16191 - protein, 229 aa, Chlamydophila pneumoniae CWL029
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYPGFTGQSFLPNTIEKIAFARHAIKTLGLKDSCLIEVDGGIDQQSAPLCRDAGADILVTASYLFEADSLAMEDKILLLRGENYGVK

SEQ ID NO: 16192 - protein, 370 aa, Triticum aestivum; identical to SEQ ID NO: 10869

SEQ ID NO: 16193 - protein, 492 aa, Oryza sativa (japonica cultivar-group)
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRVFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 16194 - protein, 644 aa, Oryza sativa; identical to SEQ ID NO: 13073

SEQ ID NO: 16195 - protein, 458 aa, Gigartina sp.
  unsure (1)..(458): unsure at all Xaa locations
PDYVVKETDVLALFRVSPQPGVDPVEASAAVAGESSTATWTVVWTDLLTACDLYRAKAYKVDIVPNTTDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEAVNRSIAASGETKGHYLNVTAATMNEXYERADSLKQLGSIIIMIDLVIGYTAIQTMAVWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRNYVAEGPQILQDAAKTCGPLQTALDLWKDITFNYTSTDTADFVETPTANV

SEQ ID NO: 16196 - protein, 458 aa, Zea mays
MMPTFLFWWCRVMLVGWGGNNGSTLTAGVIANREGISWATKDKVQQANYYGSLTQASTIRVGSYNGEEIYAPFKSLLPIVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMIMEYK

SEQ ID NO: 16197 - protein, 358 aa, Pseudomonas syringae pv. tomato str. DC3000
MVKAYSYAAQSAQDVLQPYQFERRTPGDDDVQIDILYCGVCHSDLHTARNEWHNTLYPSVPGHEIVGRVTAVGANVKQFKVGDLAGVGCMVDSCQQCASCTEGDEQYCESGFTGTYNGPVFGGENTLGGYSDKIVVKEKFVLRISHDDNLAAVAPLLCAGITTYSPLRHWKVGPGTKVGIVGLGGLGHMGVKIAHAMGAHVVLFTTSPDKREDGLRLGADEVIVSRDPAQMATQVNSLDFILNTVAAPHDLDAFLSLLKRDGTMTLVGAPAEPHPSPAVFNLIFKRRSLAGSLIGGIQETQEMLDFCAEHGIVSDIEVIDMQYINEAYERMLKGDVKYRFVIDMASLKQEVSADSNAA

SEQ ID NO: 16198 - protein, 335 aa, Borrelia burgdorferi B31
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRVVDLAQKLVK

SEQ ID NO: 16199 - protein, 335 aa, Pyrococcus furiosus DSM 3638
MDKMKIIMEKGTERLKRGFAKMVKGGVIMDVTNAEQARIAEEAGAVAVMALHKVPADIRKAGGVARMAPVEKIQEIMDAVTIPVMAKVRIGHEAEARILEALGVDMIDESEVLTPADPFFHIYKKKFTVPFVCGARNLGEAVRRIWEGAAMIRTKGEAGTGNIIEAVRHVRLVNENIRLIQRMTDEEIYGVAEKFAEPYLRLAFSVKEISGLPKRVLENEPIYEGFTYREIVDGLYKILLEIKKLGRLPVVNFAAGGVATPADAALMMAMGMDGVFVGSGIFKSSNPPAMARAIVEAVNHWDEPDVLAEISREIGEPMRGQDIAELEVRMEERGV

SEQ ID NO: 16200 - protein, 459 aa, Zea mays
  unsure (1)..(459): unsure at all Xaa locations
GGETARVTPVTTSLPHCHLFGCSSRRLARHQAAGIPISREPVAAAAAAAAAALPAPLSHWPPGWRSSLHDVALCLSPPLAARRRSGGSFVAVASMTSAAVSTRVENKKPFAPPREVHVQVTHSMPSHKIEIFKSLDDWARDNILTHLKPVEKCWQPQDFLPDPGSEGFHDEVKELRERAKEIPDDYFGWLGGDMITEEALPTYQTMLNTLDEGRDETGARPTAWAGCARACTAXEENRHGDLLNKYMYLXLGGVDMRXQIEKTIQYLIGSGMDPRTENNPYLGFIYTSFQERATFISHGNTARHAKDFGDLKLAQICGIIASDEKRHETAYTKIVEKLFEIDPDGXTVVALADMMKKKISMPAHLMFDGQDDKLFEHFSMVAQRLGVYTARDYADILEFLVDRWKVADLTGLSGEGNKAQDYLCTLASRIRRLDERAQSRAKKAGTLPFSWVYGREVQL

SEQ ID NO: 16201 - protein, 277 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDGRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 16202 - protein, 403 aa, Pseudomonas syringae pv. tomato str. DC3000
MNNEPKTLLPVEEAIARLLAMAEATPITERQRVSLADAEGRVLAVDLVSTLDLPPWPNSAMDGYALRHTDWTGEPLTVSQRIFTGQAPEPLAPGTCARIFTGAPMPEGADCVEMQENADVMADQRVRFGEPLSVGQNIRPQGQETRIGDSVLAAGTRLGPIELGLAASLGLAELEVIRRVRVAVLSTGDELIEPGQPLGPGQIYNSNRVLLCSWLKRLHCDVVDAGILPDDLLQTRAALANLHDVDLILSTGGVSVGEADFLGHALREEGELTLWKLAIKPGKPLTFGHFRGVPVIGLPGNPASTLVTFALLARAYLLRRQGVMEVAPMQFPVPAGFVWTRPGNRREYLRGRLEQGRAVVYRNQSSGVLRSAAWADGLIEVREGTTVAEGDWVSFIPLSEVLG

SEQ ID NO: 16203 - protein, 231 aa, Zea mays
TPAGSGPEFPGRPTRPLILGFIIAFVLAFSVGANDVANSFGTAVGSGVVTLKQACILASIFETVGSALLGAKVSETIRNGLIDVELYNETQDLLMAGSVSAMFGSAVWQLVASFLKLPISGTHCIVGATIGFSLVANGQKGVKWSELIKIVMSWFVSPLLSGIMSGILFFLVRAFILRKADPVPNGLRALPIFYACTIGINLFSIMYTGAPLLGFDKLPLWGTILISVGCA

SEQ ID NO: 16204 - protein, 469 aa, Porphyra kurogii
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSVICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 16205 - protein, 188 aa, Staphylococcus aureus subsp. aureus MW2
MILVVDNYDSFTYNLVDIVAQHTDVIVQYPDDDNVLNQSVDAVIISPGPGHPLDDQQLMKIISTYQHKPILGICLGAQALTCYYGGEVIKGDKVMHGKVDTLKVISHHQHLLYQDIPEQFSIMRYHSLISNPDNFPEELKITGRTKDCIQSFEHKERPHYGIQYHPESFATDYGVKIITNFINLVKEG

SEQ ID NO: 16206 - protein, 180 aa, Zea mays; identical to SEQ ID NO: 9197

SEQ ID NO: 16207 - protein, 227 aa, Zea mays
CALGGDGSPWLLVFASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADALSGIWEFSESLVPSMLPLWRQHSFPCYHVGYFLADAVIKFYSKL

SEQ ID NO: 16208 - protein, 296 aa, Escherichia coli CFT073
MSFFHASQRDALNQSLAEVQGQINVSFEFFPPRTSEMEQTLWNSIDRLSSLKPKFVSVTYGANSGERDRTHSIIKGIKDRTGLEAAPHLTCIDATPAELRIIARDYWNNGIRHIVALRGDLPPGSGKPEMYASDLVTLLKEVADFDISVAAYPEVHPEAKSAQADLLNLRRKVDAGANRAITQFFFDVESYLRFRDRCVSAGIDVEIIPGILPVSNFKQAKKFADMTNVRIPAWMAQMFDGLDDDAETRKLVGANIAMDMVKILSREGVKDFHFYTLNRAEMSYAICHTLGVRPGL

SEQ ID NO: 16209 - protein, 839 aa, Oryza sativa
MAMAARGVLAMVVAVAVVWCNNVARAQTPVFACDASNATVSGYGFCDRTKSSAARAADLLGRLTLAEKVGFLVNKQAALPRLGIPAYEWWSEALHGVSYVGPGTRFSTLVPGATSFPQPILTAASFNASLFRAIGEERMCVNIVSMVHALPQQQLRCNAPMHGCACAVQDLRQDMLVSLVTGVLRHCLMGINSEMEAQKAWSMMYNLIVLVVSTEARAMHNVGLAGLTFWSPNINIFRDPRWGRGQETPGEDPLLASKYAVGYVTGLQDAGGGSDALKVAACCKHYTAYDVDNWKGVERYTFDAVVSQQDLDDTFQPPFKSCVIDGNVASVMCSYNKVNGKPTCADKDLLSGVIRGDWKLNGYIVSDCDSVDVLYNNQHYTKNPEDAAAITIKSGLDLNCGNFLAQHTVAAVQAGKLSESDVDRAITNNFIVLMRLGFFDGDPRKLPFGSLGPKDVCTSSNQELAREAARQGIVLLKNTGALPLSAKSIKSMAVIGPNANASFTMIGNYEGTPCKYTTPLQGLGANVATVYQPGCTNVGCSGNSLQLSAATQAAASADVTVLVVGADQSVERESLDRTSLLLPGQQPQLVSAVANASRGPVILVVMSGGPFDISFAKSSDKISAILWVGYPGEAGGAALADILFGYHNPGGRLPVTWYPASFADKVSMTDMRMRPDSSTGYPGRTYRFYTGDTVYAFGDGLSYTKFAHSLVSAPEQVAVQLAEGHACHTEHCFSVEAAGEHCGSLSFDVHLRVRNAGGMAGGHTVFLFSSPPSVHSAPAKHLLGFEKVSLEPGQAGVVAFKVDVCKDLSVVDELGNRKVALGSHTLHVGDLKHTLNLRV

SEQ ID NO: 16210 - protein, 488 aa, Vaucheria compacta
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLIVERERMDKFGRPLLGATVKPKLGLSGKNYGRVVYEGLHGGLDFLKDDENINSQPFMRWRERFLYCMEGVNRAAAASGEVKGSYLNTTAGTMEEMYERAEYAKSIGSIIVMIDLVIGYTAIQSMSIWARKADMILHLHRAGNSTYARQKNHGINFRVICKWMRMAGVDHIHAGTVVGKLEGDPLMVKGFYNTLLLTKLEINLAQGIFFEMDWAALRKVVPVASGGIHCGQLHQLLYYLGDDVVLQFGGGTIGHPDGIQAGATANRVALEAMVLARNEGRDYMNEGPQILRDAAKTCGPLKTALDLWKDITFDYTSTDTPDFVETATQSR

SEQ ID NO: 16211 - protein, 301 aa, Methanosarcina acetivorans
MTFMDFEKLRHGTELIKRGFARMQKGGVIMDVTTPEQARIAEEAGAVAVMALQAVPADIRKAGGVARMADPEIVQQIIETVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPVKLAEISKGVGAGMKGISADMIPAQEALQERGW

SEQ ID NO: 16212 - protein, 686 aa, Oryza sativa; identical to SEQ ID NO: 10861

SEQ ID NO: 16213 - protein, 542 aa, Schizosaccharomyces pombe
MDSVSNVSVNEQGKFNDKEEGFSNLKSLKHVSHSETDFEVSNDEDNQLLELGYKPVFKREFSTWATFSFAFSISGLFATVVTTYSYPLISGGAPSAVWCWLIAGAGCMCIALSVAELVSAYPTSGGLYFTCKDLVPARSMPVVAWVVGWLNLLGQAAGVSSTDWSCAQLLLAAVSISTDLKYIPTNQHIVGVMAAVIVFHGLVNSLSTRWLDRITRFYATFHLIVLVVCMICLLAKCPKFNTGKYVFTDVQASSGWHPIGFSFLFGFLSVAWCMTDYDATAHIAEEIENAAVRAPNAIALALSITYVLGWVFNIVLAFTMGTDLDSLINSELGQPVAQIFYNVLGKKGSMAFTILSFIIINFTGITAMQANARTIWAFSRDQALPFSRYWYKINKTTTTPVIAVWLNVVFCIALNLIGLGSIEAIEAIFSVCAIALDWSYVIPIACKLIFGKRLNYKPGPWNLGWASHFVNAYAVCWTAFVSVIFLMPTVRPVTPQNMNYAVVVLAGVLLFSLVYWWSGARKSYIGPRINVDMESEDPFKTE

SEQ ID NO: 16214 - protein, 148 aa, Oryza sativa (japonica cultivar-group)
MDLAAVHAALAGKSYSSVAPLCDDLFLQAASRGAATDGWPYAVHLLAHLYLNDLNSARFLWKSTPQEAKDARPELAAVWRIGQCLWNRDYAGVYAAAQGFEWSPEIADFVAAFLGHHFVVWVGKSGDSDVHTYTSWSNCGNDLSAQSG

SEQ ID NO: 16215 - protein, 700 aa, Hypocrea jecorina
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 16216 - protein, 340 aa, Triticum aestivum
  unsure (1)..(340): unsure at all Xaa locations
MPSPPSSSAPSVPPRSSGLWPGLSSRAPRSSLIDVSGPSISPDYMTSMFKYDTAHGQWKHHQVKLKDPKTLLCAQKESAVFGCMNPEEIPWAXAAGAEYVVESTGXFTDKDKDAAYIKGCANTVILXAPRQDAPMSVRSVNGKGAPSYNXFQSNVCCNSNCIAPLAKVINDRFGIGEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 16217 - protein, 419 aa, ASPERGILLUS NIDULANS FGSC A4
MAYHKRPTSSYQPCDSYFVESYDDFTVPRMDPKEHAKLVARERQYAMADELSRVTSEEYRDDILSHMLDMDASTLPDVESIDIQTEIQWFMRPYLLDFLIEAHTAFQLLPSTLFLTVNLLDRYCSKRVVYKRHYQLVGCAALLIAAKYGDKKDRVPTIRELKSMCCSLYDDDMFIQMEWHVLQTLGWTIGHPTVDSFLQTAVMDTPYDPEVEHLALYIAEISLFHREFVSKPSSDLARASLALARCILNRPQPRHTEWASQYDSMTLVGLSQQLHQPSQVLARKYSSSHYSRVSKILEQFLARQASIASYTPPSPPSDVVNSESKPYEGEIGLATPQKAPHPTNMPHGYITPPITPENEAFVNGNAGYVKAVPVPSACSPSPTPSPSVQYVTHNPYQQESNYVTQQQYLQPQMSFTSGY

SEQ ID NO: 16218 - protein, 390 aa, Methanosarcina acetivorans C2A
MHRRLGGVLEVESKVRLRTIHDLSVAYTPGVAEPCRKIKENPSLVYLYTIKKNTVAVVTDGSAVLGLGNIGPCAALPVMEGKAIIFKEFAGIDAFPICLNTQDTEEVIKAVKYLAPAFGGINLEDISAPRCFEIESRLREELDIPVIHDDQHGAAIVVFAGLLNALKIVKKELGELKILITGLGAAGVAIFRFLVRAGADPAKILTCDSQGIVYEGREKDMNPIKAEIATLTNPGKLKGGLKEAFPGTDLFIGVSVGGIVTEEMISSMANDAIVMAMANPTPEIMPDAAKRAGARIVATGRSDFPNQLNNCLSFPGVFKGALGTCARKITPEMEMAAAHALANVVSVGELSEDYIIPEPLDKHVVPAVAKAVANASLESCAARRSLEDEL

SEQ ID NO: 16219 - protein, 1434 aa, Oryza sativa
MRRESTRRAPRPTGRVLLLLGSSPLSSLYICGLVPTTTLSLSLSLSPCGLAVSLARPPPPPVRPNASPAGGEEMVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGFCIMILQAGYRFLEDRGISLSLPSSCIDNAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVRKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKLHLHCKGVPRITRNHMQAAFVPSSDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSETQMSYCDAVSWFNPVVTTNVADESVRHGLVPIEVVPTFRGAEYSFDVACFRTIPVSSSMKHP

SEQ ID NO: 16220 - protein, 383 aa, Corynebacterium glutamicum
MKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 16221 - protein, 250 aa, Triticum aestivum
  unsure (1)..(250): unsure at all Xaa locations
MNRGHISSSELIDAKLEEHRXSTARHCPNCRHKLDCKPKDWLGLPAGVKFDPTDQELIEHLEAKVREEGSRSHPLIDEFIPTIDGEDGICYTHPEKLPGVTMDGLSKHFFHRPSKAYTTGTRKRRKIQTECDVHKGETRWHKTGKTRPVMANGRQKGCKKILVLYTNFGKHRKPEKTNWVMHQYHLGDLEEEKEGELVVCKIFYQTQPRQCSWSASSDRGGAGGAVAIAAAAAVTVQEQRMRDSGSGSSS

SEQ ID NO: 16222 - protein, 524 aa, Burkholderia fungorum
MPRPPLYDFVMAAALPKRAACDHQPVTQDTLLMDSFNPDDVAIRSGHYIGGEYVEAGGRRIEVARPSDGVVYATVPLADAGMVDRAVENAWQAFRHSGWARMAPRERAKILRRFAELVEADAPTLGRLEALGSTRPIAQAIGWDVPFTAEGIRFYAEFADKLGGDVAATDHDHLGMTIAEPYGVIGAIAPWNFPLVMASWKIAPALAAGNAVVLKPSEMTPFSVLRLAELAVQAGVPAGIFNVIQGDGRVTGDELVRHPKISKVTFTGSTRTGASIMAACANSGTRPVTLELGGKSPQIVFADAPRLDDVARRIAGAITGNAGQVCVAGSRLLVERSLAEPLAERIGKIFAELKPGATWAAGTTLSPIISAPQAARIEGIVGRTLEAGATLRYGGVRADVGSNGAFYTPTLLTNVTAHSEAVREEIFGPVLTLQTFDTEEEALALAQHPEYGLAAGVHTADLGRALRFVRGLEAGTVWVNRYGRTSDFMIPTGGYKRSGIGKDLGRQAYEANLRFKSVLIDLRP

SEQ ID NO: 16223 - protein, 183 aa, Arabidopsis thaliana
YPYIAGMGVYVFRKEGLLKLLRSSYPTSNDFGSEIIRARRKLHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTRIKNCIIDINARI

SEQ ID NO: 16224 - protein, 176 aa, Oryza sativa
CRSTLEDPLKSIDVYAFGVYADDHDLRQLREKYQKLPVSQLKENAELINDALERDIRMTVRLQIVYGRLSIRSVRSAFEKSVGSRLLKFGGSDTHELLQSFVSLFKDEYKLPKGSVIELSRESSHVLKISIEGEELGSIQSKLLCKSILDLYIGDDPFDKNAKESVQENMASILKN

SEQ ID NO: 16225 - protein, 368 aa, Thauera aromatica
MAAKSSVSSWRSEMSSNPHRWMMTSPGAPMVRAEFEIGELSADQVVVAVAGCGVCHTDLGYYYDSVRTNHALPLALGHEISGRVVQAGANAAQWLGRAVIVPAVMPCGTCELCTSGHGTICRDQVMPGNDIQGGFASHVVVPARGLCPVDEARLAAAGLQLADVSVVADAVTTPYQAVLQAGVEPGDVAVVIGVGGVGGYAVQIANAFGASVVAIDVDPAKLEMMSKHGAALTLNAREISGRDLKKAIEAHAKANGLRLTRWKIFECSGTGAGQTSAYGLLTHGATLAVVGFTMDKVEVRLSNLMAFHARALGNWGCLPEYYPAALDLVLDKKIDLASFIERHPLDQIGEVFAAAHAHKLTRRAILTP

SEQ ID NO: 16226 - protein, 496 aa, Zea mays
MTMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 16227 - protein, 135 aa, Zea mays
AKVLCTSPCFYVTIYINITNKVLLDQFFDHAIGINVPRSRFLPVKATSDLQLVQSDLYTLVDGFVTRNSARTNPSNPSIELGPDFKKVESFLGRFNNIPIIVELDILKVSGDIEFSSRIALKGKATITAKTGVKL

SEQ ID NO: 16228 - protein, 505 aa, Glycine max
MSSLSNNSSSSHGNSFLQMPPIKFTKLFINGDFVDSLSGRTFETIDPRTEEVIARVSEGDKEDIDIAVKAARQAFDSGPWPRLPASERAKIMMKWADLIDENIEELAALDTVDAGKLNYINKVVEIPSATNALRYYAGAADKIHGEVLKMNGDFHAYTLLEPIGVVGHIIPWNAPSLSFFIKVSPSLAAGCTMVLKPAEQTPLSALFYAHLAKLAGIPDGVLNIVPGFGPTAGAAISSHMDIDVVSFTGSIEVGREVMQAAARSNLKPVSLELGGKSPLIIFNDADIDKAAQLALFGIMSNKGEICVASSRVFVQEEIYDEFEKKLVEKAKSWVVGDPFDPKSLQGPQADRNQLEKILSYIEHGKREGATLLTGGNTVGNKGYYIEPTIFCNVKEDMLIARDEIFGPVLALMKFKTMEEAIKSANNTKYGLAAGIVTKNLDTANTMSRSIRAGIVWINCYLTVGSDVPFGGYKMSGFGRDLGLQALHKYLQVKSVVTPIHNSPWL

SEQ ID NO: 16229 - protein, 322 aa, Spinacia oleracea
MAVVSTSLASQITNPNSAVSTQFSGLRRSFLKLENSVSTQSSFFQNVDSHLRLSSSSRRCPRGVVAMAGSGKFFVGGNWKCNGTKESITKLVSDLNSATLEADVDVVVAPPFVYIDQVKSSLTGRVEISAQNCWIGKGGAFTGEISVEQLKDLGCQWVILGHSERRHVIGEQNEFIGKKAAYALNQGVGVIACIGELLEEREAGKTFDVCYQQLKAFADALPSWDNVVVAYEPVWAIGTGKVASPDQAQEVHVAVRDWLKKNVSEEVASKTRIIYGGSVNGGNCAELAKQEDIDGFLVGGASLKGPEFATIVNSVTAKKVAA

SEQ ID NO: 16230 - protein, 532 aa, Saccharomyces cerevisiae
MKAFTSLLCGLGLSTTLAKAISLQRPLGLDKDVLLQAAEKFGLDLDLDHLLKELDSNVLDAWAQIEHLYPNQVMSLETSTKPKFPEAIKTKKDWDFVVKNDAIENYQLRVNKIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTVAAGKDVYNFLELFFDQFPEYVNKGQDFHIAGESYAGHYIPVFASEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDYLNQDYVKEAVGAEVDHYESCNFDINRNFLFAGDWMKPYHTAVTDLLNQDLPILVYAGDKDFICNWLGNKAWTDVLPWKYDEEFASQKVRNWTASITDEVAGEVKSYKHFTYLRVFNGGHMVPFDVPENALSMVNEWIHGGFSL

SEQ ID NO: 16231 - protein, 90 aa, Triticum aestivum
  unsure (1)..(90): unsure at all Xaa locations
MALRGVHTVAPFQGLKCTAGMPVARRXGNSSFGNVSXGGRIRCMXVWPIEGIKKFETLYYLTPITVEDLLKQIENLLRSRGCLLEGPVPP

SEQ ID NO: 16232 - protein, 84 aa, Glycine max
  unsure (1)..(84): unsure at all Xaa locations
MKVNILQWHAVASWTWDAQDETCGICRMAFDGCCPDCKLPXDDWPLIWGVCNHAFHLHCILKWVNSQTSQAHCPMCRREWQFKG

SEQ ID NO: 16233 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRQIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 16234 - protein, 534 aa, Chlorella kessleri
MAGGAIVASGGASRSSEYQGGLTAYVLLVALVAACGGMLLGYDNGVTGGVASMEQFERKFFPDVYEKKQQIVETSPYCTYDNPKLQLFVSSLFLAGLISCIFSAWITRNWGRKASMGIGGIFFIAAGGLVNAFAQDIAMLIVGRVLLGFGVGLGSQVVPQYLSEVAPFSHRGMLNIGYQLFVTIGILIAGLVNYGVRNWDNGWRLSLGLAAVPGLILLLGAIVLPESPNFLVEKGRTDQGRRILEKLRGTSHVEAEFADIVAAVEIARPITMRQSWRSLFTRRYMPQLLTSFVIQFFQQFTGINAIIFYVPVLFSSLGSASSAALLNTVVVGAVNVGSTMIAVLLSDKFGRRFLLIEGGITCCLAMLAAGITLGVEFGQYGTEDLPHPVSAGVLAVICIFIAGFAWSWGPMGWLIPSEIFTLETRPAGTAVAVMGNFLFSFVIGQAFVSMLCAMKFGVFLFFAGWLVIMVLCAIFLLPETKGVPIERVQALYARHWFWKKVMGPAAQEIIAEDEKRVAASQAIMKEERISQTMK

SEQ ID NO: 16235 - protein, 510 aa, Zea mays
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGSRANNVIKGTKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENIMRACVGLAPENNMILEYK

SEQ ID NO: 16236 - protein, 492 aa, Agrobacterium tumefaciens str. C58
MNGGSRPMTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 16237 - protein, 148 aa, Triticum aestivum
  unsure (1)..(148): unsure at all Xaa locations
MAVAALKVQLNALLSNMFATGMVDEQFQQLQSLEEGGTASGFVAEVATLFIEDADRIIADIAALLDQXPVVDFDKVDAHVHQLKGSSSSVGAQKVKLACMHFRQFYEAKSKEGCLMALALVRSEFCDVRNKFQTMMQLEQQIEACSPK

SEQ ID NO: 16238 - protein, 480 aa, Oryza sativa (japonica cultivar-group); identical to SEQ ID NO: 6085

SEQ ID NO: 16239 - protein, 339 aa, Eremothecium gossypii
MGYNETEPAIDGDNNEQRINEDMSTLEHTSNNNGNGLEPVEAGPDSGIPAVEGGGSVSGQSPQHEPPAYELSYVVGVAENKNAKFRRTMEDVHTYVENFASRLDWGYFAIFDGHAGNQASKWCGSHLHTIIEERILQGDDRDVRDILNDSFVYVDQQINSTLEGNSGCTAAVGILRWEAPTPIPNMPINLEQHKRMLYTANVGDTRIILFRNGRSVRLTYDHKASDIIEMQRVEKAGGLIMKSRVNGMLAVTRSLGDKFFDSLVVGNPFTTSVEIPTSDQFLIIACDGLWDVVDDQEACEMIKDIEDANEAAKTLVRHALEHGTTDNVTVMVVFFDNNQ

SEQ ID NO: 16240 - protein, 85 aa, Malus x domestica
NFDLVGNNFPVFFIRDGIKFPDMVHALKPNPKSHIQEFWRILDFFSHHPESLHMFTFLFDDIGVPQDYRHMDGSGVNTYTLIDKA

SEQ ID NO: 16241 - protein, 158 aa, Escherichia coli
MKLISNDLRDGDKLPHRHVFNGMGYDGDNISPHLAWDDVPAGTKSFVVTCYDPDAPTGSGWWHWVVVNLPADTRVLPQGFGSGLVAMPDGVLQTRTDFGKTGYDGAAPPKGETHRYIFTVHALDIERIDVDEGASAAMVGFNVHFHSLASASITAMFS

SEQ ID NO: 16242 - protein, 387 aa, Halobacterium sp. NRC-1
MIPERRPREGILKDGPAVTPSMELRDLSDHVEYRAGRGIEEVARELGRDPSEFVKLSSNENPHGPSPKATIAIREAATGVHRYPKAVHADLTGALADRWDVGDDQVWVANGGDGALDYLARATLDPGDSVLVPSPGFTYYGMSARFHHGNVAEYDVAEGADGFEMTADAVVDAYDGERVVYLTTPHNPTGARFTLDEIVAVADRTDEDTLVLVDEAYGEFTETPSAVTLFDGQPAGGHAPRDDIAVLRTFSKAYGLAGIRLGYAVVPDSWADAYARVQTPFAASVIACQAGVAALDDDDHVEATTDSVAWGRDYIHDELAARTYESHGNFVLANVGDAGRVAEAAKREGVLVRDCTSFGLPEHVRITIGTRSETERAVAVLNEVCDT

SEQ ID NO: 16243 - protein, 101 aa, Vigna radiata
WLTGAPGCSSELALFYENGPFQLTKNLSLVWNDYGWDKASNIIFVDQPTGTGFSYTSDESDIRHDEEGVSNDLYDFLQAFFKEHPQFTKNDFYITGESYAG

SEQ ID NO: 16244 - protein, 250 aa, Bacillus caldolyticus
MKKKCIAMLLAGGQGSRLRSLTKNIAKPAVPFGGKYRIIDFTLSNCTNSGIDTVGVLTQYQPLLLHSYIGIGSAWDLDRRNGGVTVLPPYSASSGVKWYEGTANAIYQNMNYIEQYDPDYVLVLSGDHIYKMDYQQMLDYHIAKQADATISVIEVPWEEASRFGIMNTNENMEIVEFAEKPANPKSNLASMGIYIFNWPLLREYLQIDNADPHSSHDFGKDVIPRLLRENKRLVAYPFKGYWKDVGTVKS

SEQ ID NO: 16245 - protein, 556 aa, Arabidopsis thaliana
MSPFLKFFLFLYDYLSPSSFFLVQRNTLGASLDTTDGVVRSGIIGEIIYIWKQTRIFVFIPILKCLVTICLVMSLLLFIERVYMSIVVVFVKLLRRTPEKVHKWEPINDDDLELANTNYPMVLIQIPMYNEKEVCQLSIGAACRLSWPLDRMIVQVLDDSTDPASKELVNAECDKWARKGINIMSEIRDNRIGYKAGALKAGMMHNYVKQCEFVAIFDADFQPDPDFLERTIPFLIHNHEISLVQCRWKFVNANECLMTRMQEMSLNYHFVAEQESGSSIHAFFGFNGTAGVWRIAALNEAGGWKDRTTVEDMDLAVRACLHGWKFVYVHDVEVKNELPSTFKAYRFQQHRWSCGPANLWRKMTMEILQNKKVSAWKKLYLIYNFFFIRKIVVHIFTFVFYCLILPTTVLFPELQVPKWATVYFPTTITILNAIATPRSLHLLVFWILFENVMSMHRTKATFIGLLEAGRVNEWVVTEKLGDTLKSKLIGKATTKLYTRFGQRLNWRELVVGLYIFFCGCYDFAYGGSYFYVYLFLQSCAFFVAGVGYIGTFVPTV

SEQ ID NO: 16246 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 16247 - protein, 290 aa, Vibrio cholerae
MKGIILAGGSGTRLYPITRGVSKQLLPIYDKPMIYYPLSTLMLAGIRDVLIITTPEDSESFKRLLGDGRDFGIHLQYAIQPSPDGLAQAFLIGEEFIGNDSVCLVLGDNIFYGQSFSKTLRHAASREHGATVFGYQVKDPERFGVVEFDEQMRAISIEEKPSKPKSNYAVTGLYFYDNRVVELAKQVKPSARGELEITTLNEMYLNDDSLNVELLGRGFAWLDTGTHESLHEASSFVETVQHIQGLKIACLEEIAWRNGWLSNELILSIGESMKKNEYGKYLISLVKIKG

SEQ ID NO: 16248 - protein, 610 aa, Tetraselmis chui
MWTQYTWVVVCGALLAVFVAFGIGANDVANAFGSSVGSKAITIKQALLIAAIFEFLGAVLLGSNVTDTVRKGIANYEVFLDAPELYMYGMLSVLVATGVWLLLASYWELPVSTTHSTVGGVIGMAVTARGADAVVWYQKSNSFPFMKGVASIVLSWIFSPVLSGIFSVILFGTVRATVLRSQNSYARSWWVFPILVFITVVVNAFFIIFKGAKSKISLSATDAVWISFVCGAVAAVIVAVGVVPFLKRKIDRAEEASIKAAEAKANEDPEVAAKDVEVEAVKTDNVLRSPLHAKWESMKQIGMSLSKGVNHDVHDVVDTDTDVHDMHEFSEKFDPKTEESFKYLQVFTAICDSFSHGANDVANSIGPFAAIWAIYTHTGLAKKSEVPIWILVLGGFGIVLGLATYGYKIMCAIGVKMCRITPSRGFAIELGAAIVIVIGSQLGIPLSTTHCQVGATIGVGLLESVKKGVNWKLVGRVVIGWVMTLVIVGLTTSGLYAQGIYAPSIINIEEKNFLQSGIEGNVGAMITALNQTVYTSADPSLEGILTFNTEWIGNMTHPLQYLYAQHVPVEDSITLLSNQTWTTLSTLVPASGGDLSVVTSEEGSVFYQWA

SEQ ID NO: 16249 - protein, 131 aa, Triticum aestivum
  unsure (1)..(131): unsure at all Xaa locations
DVITMTRFVMEEGRRAKGTGEFTQLLNSLCTAVKAISTAVRKAGIANLYGIAGSTNVTGDQVKKLDILSNDLVINMLKSSFSTCVIVSEENKDAVIVEADRRGKYIVCIDPPGWXSNIDCPVSNWDIFGIL

SEQ ID NO: 16250 - protein, 428 aa, Gymnogongrus turquetii
  unsure (1)..(428): unsure at all Xaa locations
IAGESSTATWTVVWTDLLTACDLYRAKAYKVDAVPNTADQYFAYVAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYEXAEFAKQLGSIIIMIDLVIGYSAXXXXXXWARANDMILHLXRAGXSTYSRQKIHGMNFRVICKWMRMAGVDHIHAGTVVGKLEGDPLMIRGFYDTLLLPYLKVNLPXXXFFEQDWASLRKVTPVASGGIHCGQMHQLLDYLGIDVVLQFGGGTIGHPDGIQAGATANRVALESMVIARNEGRDYVAEGPXILQNGAKTCGPLQTALDLWKDITFNYTSTDTADFVETPTANV

SEQ ID NO: 16251 - protein, 246 aa, Pseudotsuga menziesii
YTYILRNIGPEGVLLRVIYCGICHSDLVQMRNEMGMSNYPMVPGHEVVGIVTEIGSEVKKFKVGERVGVGCIVGSCRSCGNCNQSMEQYCSKRIWTYNDVNHDGTTTQGGFASTMVVDQMFVVRIPENLPREQAAPLLCAGVTVFSPMKHFGMTEPGKKCGILGLGGVGHMGVKIAKAFGLHVTVISSSDKKKEEALEALHADAYLVSRDAEKMMEAAESLDYILDTIPVSHPLEPYLALLKTNGK

SEQ ID NO: 16252 - protein, 348 aa, Candida albicans
MSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 16253 - protein, 165 aa, Aegilops longissima
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 16254 - protein, 128 aa, Glycine max
MHRQSLGSPSPKVPKLITDEDDDTPKPHRLSLSLSSPPPTPPHKFVHLIPLLTLLCFFVLYLFSHSPSPSDLNHFTGFNRSPSHRLDLAEKIGGDIGQYMDVKRSDVLAIRSLQQLPKPRPHRKLADF

SEQ ID NO: 16255 - protein, 497 aa, Zea mays
MFSHGADSAHDAGTVGVSSGVGATVPARFVWPYGGKRVFVSGSFTRWSEHLPMSPVEGCPTVFQAICSLSPGIHEYKFYVDGEWRHDERQPTISGEFGIVNTLYLTREFNQINALLNPSTPGSRMNMDVDNENFQHTVTLSDGTIPEGTVRVSEAAIQISRCRVSEYLNLHTCYDLLPDSGKVIALDINLPVKQSFHILHEQGIPVAPLWDSFRGQFVGLLSPLDFILILRELETHGSNLTEDQLETHTISAWKEAKRQTCGRNDGQWRAHQHLVHATPYESLRDIAVKLLQNDISTVPVIYSSSSDGSFPQLLHLASLSGILKCIFRYFKNSTGNLPILNQPVCSIPLGSWVPKIGDPNSRPLAMLRPNASLSSALNMLVQAGVSSIPIVDENDSLLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 16256 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADRLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 16257 - protein, 161 aa, Zea mays
  unsure (1)..(161): unsure at all Xaa locations
MDARMFGLENPLVAALHHLLDVPDGDAGAGGDKAGGGATRTYVRDARAMAATPADVKELAGAYAFVVDMPGLSTGDIRVQVEDERVLMISGERXRREEREDAKYLRMERRMGKFMRKFVLPDNADVDKVAAVCRDGVLTATVEKLPPPEPKKPKTIEIKVA

SEQ ID NO: 16258 - protein, 371 aa, Nicotiana tabacum
MANEENKASPTNTSRASNNRAFDDTLAAASSNGNDPLLKRVVLGELTNLEYVVGSTKTNTHNSKRKIKLKKTAPTKRKKVAKQSFKSDAATNFSPNDDLQKCAYAPLIYQHLHSLEVEERRRPLSNYMEKIQNDVTPTMRMILVDWLVEVADEYKLVSDTLYLTVTFIDRFLSSHVLARNSLQLLGVSCMLAASKYEEISPPHVEDFCYITDNTYTGEEVVNMERELLNFLDFEISNPTTKTFLRIFTKAAQDNVDFLTLHFEFLGCYLTELSLLDYSCVQFLPSVVAASAIFLSRFTILPKVHPWNLALQQCTGYKPSELKDCVLVIHELQSGRRAASVQAVRKKYMDHKYKCVAALHPPDIPACFFDDA

SEQ ID NO: 16259 - protein, 368 aa, Nicotiana tabacum
MGIQHNEHNQDQTQSFLLDALYCEEERWEETIEDEILEKEATLPLPLPLLEQDLFWEDEELLSLFTKEKETISNFETIKTDPLLCLSRKEAVKWILKVNAHYGFSTFTAILAINYFDRFLSSLHFQKDKPWMIQLVAVTCLSLAAKVEETQVPLLLDFQVEDAKYVFEAKTIQRMELLVLSSLKWRMNPVTPLSFVDHIIRRLGLKSHIHWEFLKQCERILLLVIADCRFLSYMPSVLATATMLHVIHQVEPCNAADYQNQLLEVLNISKEKVNDCYELITEVSYNSISHKRKYESPINSPSAVIDTFYSSENSNESWDLQTSSSIPSTYSPRDQFLPLFKKSRVQEQQMRLTSLSRVFVDYAVGSPR

SEQ ID NO: 16260 - protein, 181 aa, Halobacterium sp. NRC-1
MTVEIANIVGSGDLGVELDVEPLEADLSTPYSEYDPSNYHGLYVRLEENGPLITVYRSGKYIITGCASMESLHETNEEFLGMLADLGVTEEDTQTGFTVENVVCTAMLDELVSLNALAIGLGLEVTEYEPEQFPGLVYRPEEIGAVLLVFANGKMVITGAKDTETAESAYEYFQSKVQELV

SEQ ID NO: 16261 - protein, 489 aa, Glycine max
MSQNPRLRSLQTEANCTIDKENAFISSNLSQDKKFSISQKFRKVNEILLKPTAKQYGQEAYHSQTMNPQAGNVQNKYNLEQDFESKMNISRVKKTLSFERNSMNVQRASDLLAAQKERQNYMEKENRLSIIEQRERYSFGEKQIINESKKGLTLNAARAPYAEKEPIRLNPILEPVAREDKYHEEVIPEITEREIEKIPAPTVDINEQCNNSLKDYISDIIRTLKIKDKESTPIYSLKKHKIPVNLRSKMVDWMIEVLSSYKCSDQTFFIAVNLMDLFLEKTNVQHEVSDLHLTGVTCMFMASKYEEIYPLRLSVIHEKIAHRKIHPDQIKKKEMEIFMTLGYKMTNSTPYEFIMNVLYQLNVKETMAPRLYNYLRKVCVYLAKANMHDYELLSQQDYSELAASTLFVAFKIIEQLDKSFPLFEMLNKVRQILKVEEDIVYDCASRILSIAKNFDKLYPNLENLKKFHSFNFEDLPESKDSKVCQKTIF

SEQ ID NO: 16262 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 16263 - protein, 164 aa, Arabidopsis thaliana
MGAGREVSVSLDGVRDKNLMQLKILNTVLFPVRYNDKYYADAIAAGEFTKLAYYNDICVGAIACRLEKKESGAMRVYIMTLGVLAPYRGIGIGSNLLNHVLDMCSKQNMCEIYLHVQTNNEDAIKFYKKFGFEITDTIQNYYINIEPRDCYVVSKSFAQSEANK

SEQ ID NO: 16264 - protein, 286 aa, Triticum aestivum
SGLGLLLFALLIGNMQNFLQALGSRKLEMQLIRRDVEQWMSHRRLPEDLRRRVRHAERFTWAATQGVNEEELLSNLPEDIQRDIRRHFFRFLNRVRLFTLMDWPILDAICDKLRQNLYISGSDILYQGGPVDKMIFIVRGKLESISADGSRAPLQDGDVCGEELLTWYLEHSSTNKDGGKSRFHGMRLVAIRTVRCLTNVEAFVLRASDLEQVTGQFARFLRNPRVQGAIRYESPYWRTIAAARIQVAWRYRKRRLKRAERSRPSEEPDRIPGTCSQYAFQPGQRG

SEQ ID NO: 16265 - protein, 245 aa, Orpinomyces sp. PC-2
MKSIISIAALSVLGLISKTMAAPAPAPVPGTAWNGSHDVMDFNYHESNRFEMSNWPNGEMFNCRWTPNNDKFENGKLKLTIDRDGSGYTCGEYRTKNYYGYGMFQVNMKPIKNPGVVSSFFTYTGPSDGTKWDEIDIEFLGYDTTKVQFNYYTNGQGHHEHIHYLGFDASQGFHTYGFFWARNSITWYVDGTAVYTAYDNIPDTPGKIMMNAWNGIGVDDWLRPFNGRTNISAYYDWVSYDAPRN

SEQ ID NO: 16266 - protein, 384 aa, Oryza sativa
  unsure (1)..(384): unsure at all Xaa locations
GGGEEEEERLASKPLLSSPSTYPSAGTEEGVEELELDRRYAPYARRDAYGAMGRGPLGAAGAGRLAVGAAVLFPLRLAAGVLVLVXYYLVCRVCTLRVEEEEREGGGGGAAGEVEGDGYARLEGWRREGVVRCGRALARAMLFVFGFYWIREYDCRFPDAEXVVLDDSTSPRDASSEFCDEHQEQSKELGRPGAVVSNHVSYVDILYHMSSSFPSFVAKRSVARLPMVGLISKCLGCIFVQRESKTSDFKGVSGAVTERIQRAHQQKNSPMMLLFPEGTTTNGDYLLPFKTGAFLAKAPVKPARHVFLLLCQFVNNLEVIHLPVYYPSEQEKEDPKLYANNVRKLMAVEGNLILSDLGLAEKRVYHAALNGNNSLPRALHQKDD

SEQ ID NO: 16267 - protein, 457 aa, Onslowia endophytica
  unsure (1)..(457): unsure at all Xaa locations
DYNVKNTDILALFRITPQPGVDPIEAAAAVAGESSTATWTVVWTDLLTACDIYRAKAYRVDPVPGTSDQFFAHIAYECDLFEEGSLANLTASIIGNVFGFKAVKALRLEDMRIPFAYLKTFQGPATGVIVERERLDKFGRPLLGATVKPKLGLSGKNYGRVVYEGLXGGLDXLKDDENINSQPFMRWKERYLYCMEGVNRSAAATGEVKGSYLNITASTIEDMYERAEYADSLGTVIVMIDLVIGYTAIQTMAIWARKAQMILHLHRAGNSTYARQKNHGINFRVICKWMRMAGVDHIHAGTVVGKLEGDPLMVRGFYNTLLLSELKVNLAEGLFFDMDWASLRKCVPVASGGIHCGQMHQLLYYLGDDVVLQFGGGTIGHPDGIQPGATANRVALEAMVLARNEGRDYVAEGPGILRTAAKTCGPLKTALDLWKDITFEYTSTDTPDFVEVATESK

SEQ ID NO: 16268 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 16269 - protein, 588 aa, Zea mays
MDMALASKASPPPWNATAAEQPIPKRDKAAANDSETQGSSETPRAGRGTPLRSVSHCPPITPPALSRPLPRARSDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIIEFAEKPKGEKLKAMMVDTTILGLDPERAKEMPYIASMGIYVFSKDVMLRLLRENFPAANDFGSEVIPGATEIGLRVQAYLYDGYWEDIGTIAAFYNANLGITKKPVPDFSFYDRSAPIYTQPRYLPPSKVLDADVTDSVIGEGCVIKNCTINHSVVGLRSCISEGAVIEDTLLMGADYYETENDKNVLSETGGIPIGIGKNSHIRKAIIDKNARIGENVKIINFDNVQEAVRETEGYFIKSGIVTVIKDALIPSGTII

SEQ ID NO: 16270 - protein, 349 aa, Actinobacillus pleuropneumoniae serovar 1 str. 4074
MKLKKLALSAVLSMAISSVYAAELPNITILATGGTIAGSGQSAVSSAYQAGQLNIDTLIEAVPEMKTLANIKGEQVVKIGSQDMSDEVWLKLAKTVNSQCANTDGFVITHGTDTMEETAYFLDMTVKCDKPVVLVGAMRPATEKSADGPLNLYNSIVVAKDKKSAKRGVLVAMNDVVLGARDVTKTSTTAVQTFSSPNFGTLGYIHNSKVDYERAPESKHTLNTPFTIDNLNELPKVGIIYAYSNMPTEPLKALLDAGYQGIVVAGVGNGNMNAANLALLEQAAKNGVAVVRSSRVPTGYTTRDAEVDDSKYGFAASGTLNPQKARVLLQLALTQTKDINTIQQYFEDF

SEQ ID NO: 16271 - protein, 311 aa, Oryza sativa
SDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRDLGEALRRIREGAAMIRTKGEAGTGNVVEAVRHVRSVMGDIRALRSMDDDEVFSYAKRIAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 16272 - protein, 266 aa, Neurospora crassa
MSAVDTPTGAASSSKPDQNEQNGQNGGREDSGGFKLKFCTVCASNQNRSMEGHLRLSLANYPVISFGTGSLVRLPGPSITQPNVYKFNETSYDSIYRELEAKDPRLYRANGLLNMLGRNRQVKWGPERWQDWQIGMPRTKHKDDKGADGMEGGVADVVITCEERCWDAVIEDLLNRGSPLNRPVHVINIDIKDNHEEASVGGRAIVDLADSLNKIAAEEREKVGASAFDSGSVGARSGFDERVPDVLAEWQERWPNLPATWTLAWF

SEQ ID NO: 16273 - protein, 447 aa, Glycine max
  unsure (1)..(447): unsure at all Xaa locations
RVGRRIVGPRARVHYNLKKSVLVTPSDNWLRCDDSLVMQFLEIKNGYNYFRYVHSLSYSQSQRAFEAAKAINDINGIASILQHRPYHIDSLLTMAEYFAVLGEQQMSADAIARCLYALECAWHPMFNPLQGNCRLKFKHDTNKPIFTALFTHMKNLDRRGCHRSALEVCKLLLSLDSDDPMGAIFCIDYFALRAEEYAWLEKFSEEYKSDNSIWLFPNFSYSLAICRFYLEAXACKDDCMDAEKASSSDLMKQALMLHPSVIKKLVAKVPLKDRTWTDILKHAFFRSDQTGIPSQDHLINIYVERNYLIWRLPDLQKLLSGAAKLVIETLESNKSELKDWACVRKEAFSSEKNEYGHLLVSEFSDSLSSIPRENLQQFMGVPRMMEGMQDENQFANLPGNGHAPRGVANRNALAVLFESMLPWVTYEDGVDGEPDDNQHDDHRQDNQ

SEQ ID NO: 16274 - protein, 543 aa, Candida tropicalis
MSSSPSIAQEFLATITPYVEYCQENYTKWYYFIPLVILSLNLISMLHTKYLERKFKAKPLAVYVQDYTFCLITPLVLIYYKSKGTVMQFACDLWDKNLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 16275 - protein, 429 aa, Novosphingobium aromaticivorans
MAAGRRAFASFSVSPAQERIALLGRILSLMEERAEALAQAVTLEMGCAISFSRTAQVPFGVAHVRAALKVLHDFPFLTPQGSTAILREPIGVCGLITPWNWPLYQITAKLAPALAAGCTVVLKPSELSPFSAALLAQIVHDAGTPAGVFNMVTGTGPGVGEAIAAHGDIDMVSITGSTRAGVLVAQAAATTVKRVTQELGGKSPNILLDDADFERVVPLGIAAGMRNVGQSCSAPTRMLVPRHRLTEVEQLAANAANALVVGDPLAEATDLGPVANSRQFDKVQQMIAVGQAEGARLLCGGPGRPEGLDRGFFCRPTVFTCDDPAMRVAQEEIFGPVICVIPYDDDDHAVRIANDTIYGLGSHVQSADIDRARTVAARIRAGQVHINHPAWDGHAAFGGYKQSGNGREYGRFGLEEYLETKAVLGYFPQ

SEQ ID NO: 16276 - protein, 475 aa, Ostreococcus tauri
MSERRIARGRDARARVVTRMDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTI

SEQ ID NO: 16277 - protein, 354 aa, Zinnia elegans
MGSNQDDQAFLFAMQLASASVLPMVLKTAIELDLLETIAKAGPHGSVSSSELVAQLPKVNNPEAPVMIDRICSLLASYSVLTCTLKETADGCAERFYGLAPVCKFLIKNDAGVSLAPLLLMNQDKVLMESWYYLKDPVLDGGIPFNKAYGMSAFEYHGKDQRFNKVFNSGMFNHSTMTMKKIVELYNGFSGLKTLVDVGGGTGASLNMITSKHKSLKGINFDLPHVIADATTYQGIEHVGGDMFESVPKGDAIFMKWILHDWSDAHCLQVLKNCYKSLPENGKVIVAECILPEAPDTTPATQNVIHIDVIMLAHNPGGKERTEKEFEALAKGAGFKGFNKAACALNTWVMEFCK

SEQ ID NO: 16278 - protein, 493 aa, Galdieria partita
MSQSIEEKSVQERTRIKNSRYESGVIPYAKMGYWNPDYQVKDTDVLALFRVTPQPGVDPIEAAAAVAGESSTATWTVVWTDLLTAADLYRAKAYKVDQVPNNPEQYFAYIAYELDLFEEGSIANLTASIIGNVFGFKAVKALRLEDMRLPLAYLKTFQGPATGVILERERLDKFGRPLLGCTTKPKLGLSGKNYGRVVYEALKGGLDFVKDDENINSQPFMRWRERYLFTMEAVNKASAATGEVKGHYLNVTAATMEEMYARANFAKELGSVIIMIDLVIGYTAIQTMAKWARDNDMILHLHRAGNSTYSRQKNHGMNFRVICKWMRMAGVDHIHAGTVVGKLEGDPIITRGFYKTLLLPKLERNLQEGLFFDMEWASLRKVMPVASGGIHAGQMHQLIHYLGEDVVLQFGGGTIGHPDGIQAGATANRVALEAMILARNENRDYLTEGPEILREAAKTCGALRTALDLWKDITFNYTSTDTSDFVETPTANI

SEQ ID NO: 16279 - protein, 607 aa, Geobacter metallireducens
MPRWLLRHTPARLPQPNRNDSAIAPVDQSLHYLISLLGGFSMKMTGARILLECLKREGVDTVFGYPGGTVINLYDELFSFKDIRHILPRHEQAGVHAADGFARATGRVGVAIATSGPGATNTVTGIATAYMDSIPLVVITGQVPTALIGNDAFQEVDIIGITRPCTKHNFLVKDVKDIATIIKKAFYIARTGRPGPVLVDLPKDVQIATAEFEYPEAIELRSYKPTVEGHPKQIEKAVSMLLAAKKPVMYVGGGAISGDAAGELTALATRLHIPVTTTLMGLGSFPEDNPLSLKLLGMHGTYFANMAVTNCDLLVAVGARFDDRVTGKIATFAPHAKIIHMDVDPTSIRKNVRVDLPIVGQVKEVLGRMLKSLDESGDKVAAFHTAIEPWLAEIEGWKQKHPITYKQASTVIKPQFVIQKLRELSDPDAIVATDVGQHQMWTAQFFGFREPRTLLSSGGLGTMGFGLPAAMGAQAAFPNRQVIAVCGDGGFQMNLQEVATLVQNRLPVKIVILNNNFLGMVRQWQELFFDKRYSQTCMELPIDFIKLAEAFGAKGFQATKSDEVEATIKKAFETPGPVIMEFKIAREEKVLPMVPAGASLNEMVLNA

SEQ ID NO: 16280 - protein, 71 aa, Zea mays
SRGVGCPIPSARPLDVIPPAALDPYKHRPSSGSNSSFWTTNFGARVWNNNSALIVGRRGSILLADYYLFEK

SEQ ID NO: 16281 - protein, 484 aa, Escherichia coli
MSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 16282 - protein, 357 aa, Glycine max
MGSLEAERTTVGLAARDPSGILSPYTYNLRNTGPDDVYIKVHYCGICHSDLHQIKNDLGMSNYPMVPGHEVVGEVLEVGSDVSRFRVGELVGVGLLVGCCKNCQPCQQDIENYCSKKIWSYNDVYVDGKPTQGGFAETMVVEQKFVVKIPEGLAPEQVAPLLCAGVTVYSPLVHFGLKESGLRGGILGLGGVGHMGVKIAKALGHHVTVISSSDKKKQEALEHLGADQYLVSSDVTAMQEAADSLDYIIDTVPVGHPLEPYLSLLKLDGKLILMGVINTPLQFVSPMVMLGRRSITGSFIGSMKETEEMLEFWKEKGLSSMIEVVNMDYINKAFERLEKNDVRYRFVVDVKGSKLVD

SEQ ID NO: 16283 - protein, 333 aa, Bacillus subtilis subsp. subtilis str. 168
MKLLKREGLSLTEEKALWMYQKMLEIRGFEDKVHELFAQGVLPGFVHLYAGEEAVAVGVCAHLHDGDSITSTHRGHGHCIAKGCDLDGMMAEIFGKATGLCKGKGGSMHIADLDKGMLGANGIVGGGFTLACGSALTAKYKQTKNVSVCFFGDGANNQGTFHEGLNLAAVWNLPVVFVAENNGYGEATPFEYASACDSIADRAAAYNMPGVTVDGKDILAVYQAAEEAIERARNGGGPSLIECMTYRNYGHFEGDAQTYKTKDERVEHLEEKDAIQGFKNYLLKETDANKLSDIEQRVSESIEKAVSFSEDSPYPKDSELLTDVYVSYEKGGM

SEQ ID NO: 16284 - protein, 438 aa, ASPERGILLUS NIDULANS FGSC A4
MPISKIHARSVYDSRGNPTVEVDVVTETGLHRAIVPSGASTGQHEAHELRDGDKSKWLGKGVLTAVKNVNETIGPAVIKENLDVKEQSKIDEFLNKLDGTPNKSNLGANAILGVSLAIAKAGAAEKGVPLYAHISDLAGTKKPYVLPVPFQNVLNGGSHAGGRLAFQEFMIVPDTASSFSEGLRQGAEVYHKLKALAKKKYGQSAGNVGDEGGVAPDIQTAEEALDLITEAIEQAGYTGKIHIAMDVASSEFYKPEEKKYDLDFKNPDSDPSKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADISVGLRSGQIKTGAPARSERLAKLNQILRIEEELGENAVYAGQNFRKSVNL

SEQ ID NO: 16285 - protein, 209 aa, Zea mays
CSTCRIISFDLGVQVIAGSLPPPQPEEKLGECQLNRALVFDDSPDNSDESSGSAVPSSVSLQEGSAGKTSSPEEGDSSSAWSTQVHASSEKGDQEELDVEELAADYTEEEEDFEEEDDWEEDSDDGCYDDLCDVMSRMTVLDEGEKKTGLPQFEGKHTRFIYNSDDEIEREEVADAAEARAELGALMLRGLPVPEGRHLRFHDDEDDEE

SEQ ID NO: 16286 - protein, 301 aa, Chlamydophila caviae GPIC
MSIFLVFFTAFIWSSSFAFSKLAMEVSAPLFVTGSRMLVAGLVLAAIVLWKKGSLKLPKQVYVPVLILALVGFYLTNVCEFVGLQNLSSSKACFIYGLSPFISALFSYIQLRETVTVKKIAGLSLGLVGYLFYLFFGGSNSTETWSWQLGVPELLLLLATCLSAFGWTLLRKIEKNSSLSVMAINAYAMLISGVLSLGHSMVVETWNPIPVSNGVVFVQAVFCLVLFSNLISYNLYAKLLRKYSSTFLSFCNLVMPLFSAFYGWLLLGESLSGSLLMAVVFMVVGCRLIYHEEFRQGYIVS

SEQ ID NO: 16287 - protein, 306 aa, Shigella flexneri 2a str. 301
MKFRGGRMSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHSTRPAVMSLVIWSALIPIIPFFVVSLILDGSASMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 16288 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 16289 - protein, 251 aa, Coprinopsis cinerea
MTRSFFVGGNWKLNPTSLSAAKAPVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 16290 - protein, 159 aa, Triticum aestivum
MKSFLSLLCSVFLLPLVVQSVPVIKRASASDWENRVIYQLLTDRFAKSTDDTNGCSNLSDYCGGTFQGIINHLDYIAGMGFDAIWISPIPKNVNGGYHGYWASDFSQINEHFGTADDLKKLVAAAHAKNMYVMLDVVANHAGTPSSGGDYSGYTFGQSF

SEQ ID NO: 16291 - protein, 514 aa, Staphylococcus aureus subsp. aureus Mu50
MVVEFKNEPGYDFSVQENVDMFKKALKDVEKELGQDIPLVINGEKIFKDDKIKSINPADTSQVIANASKATKQDVEDAFKAANEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNTVLLKPAEDTPYIAYKLMEILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 16292 - protein, 170 aa, Oryza sativa (japonica cultivar-group)
MGEIRTLRDMDDDEVFAYAKRIAAPYDLVMQTKQLGRLPVVLFAAGGVATPADAALMMQLGCDGIFVGSSIFKSGDHARHARTIVQAITHCRSLRPSTLPPRRPRWHTFAVELCPVCRDREREEEMNGEKERKKKNGEREIDKWANLSLTKVSLSILTGNNKIMGGASNS

SEQ ID NO: 16293 - protein, 458 aa, Glycine max
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 16294 - protein, 509 aa, Zea mays
MVKAVVVGAAVVACAAVGVAVVLERRRRKRDADLLGSAEAERRRRAAAVIEEVESSLATPTALLRGIADAMVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPANQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSNKLPLSEYDKAMDFESLNPGEQIYEKMISGMYLGEIVRRILLKLAHEASLFGDVVPPKLELPFILRTPDMAAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 16295 - protein, 121 aa, Salmonella enterica
KNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 16296 - protein, 457 aa, Salmonella typhimurium LT2
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 16297 - protein, 276 aa, Zea mays
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLGLAALHSSPEFVVIIKSATVKSSSCLVVFEMHAVACRSGFCLSL

SEQ ID NO: 16298 - protein, 841 aa, Bifidobacterium longum NCC2705
MLTFVRRYLSRGIINTGTYPGRKVRMTEITAPKSPVTAEQFADEIREQLKYTQNVTTEQATPADVYVAASKAVRNHLADSWFKTQADTVNGNTKAVGYLSAEFLMGKQLRNALLNAGLTEQFDKAVEALGFKVQDVVDAEYEPGLGNGGLGRLAACFIDSLASLGVPAFGYGIQYKYGIFKQEFDKDGKQVETPDYWLANEEPWGHIDYNRDQKVSFGGKVVENADGTKTWQPAWSVRAVPVDYLVPGYKSGRVNTLRLWSAKSYDEFDLLAFNRSEYMEAVTPQVKAENISKILYPEDSTKVGKELRLEQQYFFVSASLHDAIRVFYPGQDKPDLTTFPNKIVFQLNDTHPVIGIPELMRILIDEYGYDWDTAWSITTKTFNYTCHTLLPEALEVWPASLIGELLPRHLEIIEKINAQFEDELKSKGVDKNTIKDMAIYTGDAVRMAYLATYGGSHVNGVAELHSQLLKDVTLKNFSDVYPDKFTNVTNGVTPRRFVKLANPRLSDLITEGLGTDKWLSDLEMLKGLEPLAKDDEFVKKFAAVKKANKVDFAAYAKREYGFELDPNTMFNTMVKRLHEYKRQSLKILSVISTYADIKSGKVKAEDVTPRTVFFGAKAAPGYYLAKMTIQLINNVSRVVNNDPDVKGKLAVYFPWNYNVRLAQHLIPATDLDEQISQAGKEASGTGNMKFALNGAMTVGTLDGANVEIRERVGAENFFLFGMTVDEVEKKYAEGYNPASYYEADPRLKHAIDMVADGTFSNGDRNAYSPLVADWLTKDWFMTLADFSAYMDIQSEIEALYADELEWNRKALLNVANSGYFSSDRSMEDYLERIWHTAPLAD

SEQ ID NO: 16299 - protein, 433 aa, Pneumocystis carinii f. sp. ratti
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 16300 - protein, 370 aa, Oryza sativa (japonica cultivar-group)
MGSLELSKNKCNGGQEVSLLDAQLELYSNTFAVIKSMALKSALDLGIADAVHRHGGAATLAEIASEVALHPSKIPCLRRLMRALTVSGVFAAAVKPGDGGGGEPVYELTPSSRLLVGSSNLSGIMSMILHPTLVVPFLGVGEWLRRDREPPEEDPYCIFKQAHGRSLWELAGRDAAFDALINDGMVSDSRVIMDYVVREHGEVFRGIASLVDLAGGLGAAAQVISKAFPEVRCSVMDLGHVVAKAPAGTDVEYIAGDMFESVPPADAVFLKWVLHDWGDNDCIKILKNCKKSITPRDKGGKVIIMDIVVGAGPSDQKHREVQALFDMYIMLVNGIERDEQEWKKVFVEAGFSGYKIMPILGFRSMIEVYP

SEQ ID NO: 16301 - protein, 240 aa, Zea mays
RVIRAAGARPLAVVQLLLFLADNMSGKSTLSEVRTSSGTFLRKGQDPIVESIEDKIAAWTFLPKENGEDIQVLRYKHGEKYEPHYDYFTDNVNTVRGGHRYATVLLHLTDVPEGGQTVFPLAEEPDDAKDATLSECAQKGIAVRPRKGDALLFFNLNPDGTTDSVSLHGGCPVIKGEKWSATKWIRVASFDKVHHPQGNCTDENESCAKWAALGECIKNPEYMVGTTALPGYCRRSCNVC

SEQ ID NO: 16302 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 16303 - protein, 160 aa, Xylella fastidiosa Dixon
MNVVRYTPWPGQAALQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLRILIPKQAATTPRRIQVGNAVSSDVALQSM

SEQ ID NO: 16304 - protein, 167 aa, Oryza sativa (japonica cultivar-group)
MGEKTEYRDRLVENAFMGLFARKIKKYAVISSSGGKEKKKSSSRSSSCRHVGQLGLRVQRRPHHSLFPLARRSIRVTAVESVMQALMFLDSEHDVNMIVSDYCMPDMTGYDLLMEVKKSPKLAHLPVVIASSDNIPERIRKCLDGGAKDYILKPVKIVDLPRILNYI

SEQ ID NO: 16305 - protein, 772 aa, Ruminococcus albus
MIINLLKRRIKVMDIAHIMEIMTLEEKASLCSGADFWHTKAIERLDIPQIMVSDGPHGLRKNVDGSNDPNEAIEAVCFPTAAALACSYDRELLKDIGKALGEECQSEKVSVILGPGCNIKRSPLCGRNFEYFSEDPYLASQMAISHIKGVQSKGAGTSLKHFAANNQEHRRMSVSAEIDERTLHEIYLAAFESVIKEAKPWTVMCSYNKINGEYSSQNKSLLTDTLREKWGFDGLVMSDWGAVDDRVKGIEAGLDLEMPGSMCKNDKMILKAVEDGKLSVEALDKCVKRILELIDKSLECRTEMDWDKERHHQLAQKAAEKSAVLLKNDDHILPLSKNEKIAFIGAFAEQPRYQGGGSSHINSFRTVSALEAVDGWENITYAKGFSLDNDEINTELEQQAVEAAMNADKVVVFAGLPDSFESEGFDRKHMQLPQCQIDLIDKLSEVNPNIVVVLHNGAPVEMPFANGDEDSNSVKAILEMYLSGQAAGEAVVRILFGEVNPSGKLAETFPLRLEDNPSYLNFPGEADIVKYSEGIFVGYRYYEKKNMEVLYPFGHGLSYTEFEYSDIKISSYEISDKKAFTVEMTVTNSGSRDGEEIIQLYIEPLTPTVIRPIKELKGFEKVFLKAGESKRVVFRLDSSAFAYYSDKIHDWLSESGYYNILIGKSSADICLEEQVHFNSSVRIPILFTLDNTVSDINSTAEGKKLFKDMMSTVFATANGGADQLGDSAREMEMAIANDLPLHAMVSFTDNPDITREKLQMMLDKLNVIINSK

SEQ ID NO: 16306 - protein, 249 aa, Zea mays
MSSSSGTTMPLAYQTSASSPEWLNKGDNAWQLTAATLVGLQSFPGLVVLYGGVVKKKWAVNSAFMALYAFAAVWICWVTWAYNMSFGDRLLPLWGKARPALSQGGLVGQAGLPATAHHFASGALETPAAEPLYPMATVVYFQRVFAAITLVLVAGSLLGRMSFAAWMLFVPLWLTFSYTVGAFSVWGGGFLFQWGVIDYCGGYVIHLSAGFAGFTAAYWVSRSIDRSSANNACVQRAVFISELNSYMPA

SEQ ID NO: 16307 - protein, 121 aa, Oryza sativa (japonica cultivar-group)
MSSPHVLVVDDTHVDRHVVSMALMRHNVRVTAVESVMQALMFLDSEHDVDMIVSDYCMPDMTGYNLLMEVKKSPKLAHLPVVIASSDNIPERIRKCLDGGAKDYILKPVKIVDVPRIMKYI

SEQ ID NO: 16308 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 16309 - protein, 139 aa, Pisum sativum
NTDITSITSNGGRVKCMQVWPPIGKKKFETLSYLPPLTRDQLLKEVEYLLRKPWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 16310 - protein, 294 aa, Escherichia coli O157:H7 EDL933
  unsure (1)..(294): unsure at all Xaa locations
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLADAFGPKDLEIKTLLMDEQDHGYALTGDALSQAAIAAANRSHMPYSKSPSGVALECKDGRIFSGSYAENAAFNPTLPPLQGALILLNLKGYDYPDIQRAVLAEKADAPLIQWDATSATLKALGCHNIDRVLXA

SEQ ID NO: 16311 - protein, 486 aa, Lotus japonicus
MATPTAYQENLPASPEWLNKGDNAWQMTAATLVGLQSMPGLVILYASIVKKKWAVNSAFMALYAFAAVLLCWVLLCYRMAFGDKLFPFWGKGAPALGQKFLINQASVPESTHYFNNGSIETQTQRPFYPMATLVYFQFNFAAITMILLAGSVLGRMNIKAWMAFVPLWLIFSYTVGAFSIWGGGFLYHWGVIDFSGGYVIHLSSGIAGFTAAYWVGPRLKSDRERFPPNNVLLMLAGAGLLWMGWSGFNGGAPYAANIDASIAVLNTNICAATSLLVWTSLDVAFFGKPSVIGAVQGMMTGLVCITPGAGLVQSWAAIVMGILSGSIPWVSMMILHKKSSLLQKVDDTLGVFHTHAVAGLLGGLLTGLLAEPELCRLVLPVSNSRGAFYGGTGGAQFLKQLVAALFVIGWNLVSTTLILLAIQLFIPLRMPDYQLEIGDDAVHGEEAYALWGDGEKYDPTKHGSTIVDETLASAYSVGARGVTVNL

SEQ ID NO: 16312 - protein, 396 aa, Helianthus annuus
MAIRINTATFQSDLYRSFAFPQPKPLRSPKFAMASTIGSATTKVESTKKPFTPPREVHQQVLHSMPPQKIEIFKSMEGWAENNILVHLKPVEKCWQAQDFLPDPASDGFMEQVEELRARAKEIPDDYFVVLVGDMITEEALPTYQTMLNTLDGVRDETGATLLLGLVWTRAWTAEENRHGDLLHQYLYLSGRVDMRQIQKTIQYLIGSGMDPRTENSPYLGFIYTSFQERATFISHGNTARHAKEHGDVKLAQMCGIIAADEKRHETAYTKIVEKLFEIDPDGTVLAFADMMRKKISMPAHLMYDGRDDNLFENFSAVAQRLGVYTAKDYADILEFLVGRWKVADLTGLSGEGRKAQDYVCGLAPRIRRLEERNSARAKESVNVPFSWIFDREVKL

SEQ ID NO: 16313 - protein, 426 aa, Batrachospermum macrosporum
IEASAAVAGESSTATWTVVWTDLLTACDLYRAKAYKVDAVPNTADQYFAYIAYDIDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWRERFLFSIEGVNRAQAATGEVKGHYLNVTAGTMEDMYERAEFAKELGSVICMIDLVIGYTAIQTMAVWARKADMILHLHRAGNSTYSRQKIHGMNFRVICKWMRMAGVDHIHAGTVVGKLEGDPLMIKGFYNTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADF

SEQ ID NO: 16314 - protein, 498 aa, Alcaligenes faecalis
MGSAKSVKKLSSGRLMMSSRCRPTCGPAIRPRAAQHAFSRFQPARFTVAWAFSQKRLGSEPMHTEHAYALPECRNLFYGGRFHVPQGGYGRTLNPATQEDLGPVSNANAADVDAAVQAAHLAFQSWRHTKPAVRAAALREFGNRLRTHAEELGFLDAINCGNPVREMAADVHFAATQVDYFAGLVHEAKGDTLPMGDGVLNYSVREPYGVVARIVAYNHPLMFLAAKLAPAVAAGNTVILKAATQAPLSAYRLATLLQDVFPPGVVNVLSGDTPCGQALVDHPLVKKVSLIGSTATGKSILRSAAEKVMPVSLELGGKNPLIICPEADMDKAIEGAVKGMNFTWAGQSCGSTSRCFVHRSVYDRVIKEMVQKISQLYRCGLPTDPATTMGCLVSKAQYEKVMSFIDSAHKEGARLVCGGVRPSDKALDNGWFVTATVFADVTPAMRLFREEVFGPVLAVIPWDEEEESAAHGQWAGFRLDRFNMDKGSGPRPSPGISR

SEQ ID NO: 16315 - protein, 209 aa, Oceanobacillus iheyensis HTE831
MNKQEIIQRILIVFTTTLAVACIGIYMGQYIPKQWMLPLMIIEIIMLIAAALLRRRSRVGYIFLFSFVVISGITMFPAIYFYVSEIGAVVVLFVFLLTLMIFTILGMVGWVLQKDLSFMGSTLFIILIVLIAFSIFTWFIPQSDTVLVIVACVSAGLFSVYIVYDFNQIKHRALTAKDVPSAVLSLYLDVVNLFLHLLRIISYVFKNRG

SEQ ID NO: 16316 - protein, 348 aa, Glycine max; identical to SEQ ID NO: 7313

SEQ ID NO: 16317 - protein, 162 aa, Triticum aestivum
  unsure (1)..(162): unsure at all Xaa locations
MAPAVMASSATTVAPFQGLKSTAGLPVSRRSSGSLGRVSNGGRIRCMQVWPIEGIKNSETLSYLPPLSTEASLKQVDYLIXRSKWVPCLXFNKVGFSFRXAXSPPGYNDXPYWTMLELAIFXXTDPASLNKVEESKRIPDPIPLIGXTQFILNSIKHGSREG

SEQ ID NO: 16318 - protein, 162 aa, Oryza sativa
TDGMGTAEWRASKSPAYYKRGDYVPGLKVDGMDVLAVKQACKFAKQHALENGPIILEMDTYRYHGHSMSDPGSTYRTRDEIAGIRQERDPIERVRKLLLAHDFATTQELKDMEKEIRKQVDTAIAKAKESPMPDPSELFTNVYVNDCGLEVSRCQEQFIQNS

SEQ ID NO: 16319 - protein, 289 aa, Glycine max
MAKGKHSHTRAQGKKWSTFSLVLWALFFLTLILVVLLALGIVYLPTTDDDFPTTELSAFRRKTSQSGESLVENSEQWTEILSWEPRAFIYHNFLSKEECEYLIELAKPHMVKSSVVDSKTGKSTESRVRTSSGMFLKRGRDKIIQNIEKRIADFTFIPEENGEGLQILHYEVGQKYEPHYDYFLDEFNTKNGGQRIATVLMYLSDVEEGGETVFPAANANFSSVPWWNDLSQCARKGLSVKPKMGDALLFWSMRPDATLDPSSLHGGCPVIKGNKWSSTKWLHLHEYKV

SEQ ID NO: 16320 - protein, 332 aa, Bacillus anthracis str. A2012
MDTLLILTVLVVICALAFDFINGFHDTANAIATAVSTKALKPRHAIVMAAIMNFLGAMTFTGVAKTITKDIVDPFALQNGSLVILAALLAAIAWNLITWYYGIPSSSSHAIIGSIAGAAIAAAGISSLNLKGFIKIIEALIISPIIAFVIGYTVYSIFKVVFKNFNLTKTNKNFRIFQIFTAALQAYTHGTNDAQKAMGIITMALMANNYHTSSDIPFWVQLSCAIAMGLGTSVGGWKIIKTVGGQIMKIRPVNGVAADLSSSLVIFGATFIHLPVSTTHVISSSILGVGASHRVKGVKWGTAKRMLITWVITLPISASLAALFYSLLHLIF

SEQ ID NO: 16321 - protein, 320 aa, Arabidopsis thaliana
MDSHEEQCLPILDFSSDKLVRGTSHWITTRDDVRRAMEGQGWFVAEFSGVSSDLRDNLLAGMKEMYYLPDQIKIKNENHKASHGYMSMVVDDYRIHESLGIDYATELQACKDFSKLLWPQGNDPFCQTTHMYAMTMAELDQTVMRMLYESYGMDEKKHSVSHSESTRYLLRMLSYRRQQNGEANTGFVSHTDKSFMSILHQNHVGGLQLKTMTGQWVGFNPSPTRFVVLSGMGLTAWSNDRIKACYHKVVMSADEIRYSLGFFSFHKGTIRTPEELVDDQHPLRYNPFEHDGLLRFYESYINSLKKSSEDLLQIYCGVTP

SEQ ID NO: 16322 - protein, 252 aa, Triticum aestivum; identical to SEQ ID NO: 14050

SEQ ID NO: 16323 - protein, 529 aa, Plantago major
MTADHQKSSVASFAVSSGDAGKLGLSSTLDTLPKKPLKRNKYALAISILASMTSVLLGYDCGVMSGATQFIQEDLIITDVQVELLVGTINIYSLVGSAVAGRTSDWVGRRYTIVFASTIFFLGAILMGFATNYAFLMVGRFVAGIGVGYALMIAPVYAAEVAPASCRGFLTSFPEVFINFGVLLGYVSNFAFAKLPLTLGWRMMLGVGAVPSVLLGVGVLYMPESPRWLVLQGRLGDAKKVLDKTSDSLEESKLRLADIKEAAGVPLDCHDEIVQVQKRSQGQGVWKELLLHPTKPVLHILICGVGIHFFQQGIGIDSVVLYSPRIYEKAGIKNTSDKLLATIAVGVSKTFFILITTFFVDRFGRRPLLLTSCAGVALSMFALGTSLTIIDRNPDGNIKGLLIFAVILTMAIVGFFSMGLGPIAWVYSSEIFPLKLRAQGCSMGVAMNRFMSGVILMSFISLYKAITIGGAFFLFGGITTVAFIFFYTLFPETQGRTLEEMEELFGTFFSWRTRMKELDAKKKTGSEAT

SEQ ID NO: 16324 - protein, 89 aa, Triticum aestivum
  unsure (1)..(89): unsure at all Xaa locations
TGVGRGAHISLNVKGQDGNEVFFRIKRSTQLKNLMNAXCDGQSVDLNSSAFLFDGRTLRGKQTPDELEMEEGDEIDAMLHETGGCFPGP

SEQ ID NO: 16325 - protein, 333 aa, Escherichia coli O157:H7 EDL933
MSKVGINGFGRIGRLVLRRLLEVKSNIDVVAINDLTSPKILAYLLKHDSNYGPFPWSVDFTEDSLIVDGKSIAVYAEKEAKNIPWKAKGAEIIVECTGFYTSAEKSQAHLDAGAKKVLISAPAGEMKTIVYKVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKQATTNNESFGYTDEEIVSSDIIGSHFGSVFDATQTEITAVGDLQLVKTVAWYDNEYGFVTQLIRTLEKFAKL

SEQ ID NO: 16326 - protein, 219 aa, Pseudomonas fluorescens PfO-1
MQRPGKSSEGCLQVRIQEVRNAMLLMIDNYDSFTYNVVQYLGELGAEVKVVRNDELTIAEIEALNPERIVVSPGPCTPTEAGISIEAIKHFAGKLPILGVCLGHQSIGQAFGGDVVRARQVMHGKTSPVFHEDKGVFAGLNRPLTVTRYHSLIVKHETLPDCLELTAWTQHDDGSVDEIMGLRHKTLNIEGVQFHPESILTEQGHELFANFLKQTGGTR

SEQ ID NO: 16327 - protein, 367 aa, Zea mays; identical to SEQ ID NO: 2221

SEQ ID NO: 16328 - protein, 261 aa, Xylella fastidiosa Temecula1
MRTMTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 16329 - protein, 467 aa, Laurencia arbuscula
PYAKMGYWDPNYVVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAATGEVKGHYMNITAATIEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYNTLLEPYLAVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 16330 - protein, 468 aa, Nostoc sp. PCC 7120
MPANSWPDNDSYKELDPLNSLLSDVSTTEESVVETRDLSLPSRFQGRRGKAALVLTIVWSGTIALHLVSWGSIFILGLTTVLGIHALGVVFARPRHYQKEIQGSLPFVSILVAAKNEEAVIAKLAKNLCNLEYPNGQYEVWIIDDNSTDKTPHILAELAKEYDKLKVLRRSAQATGGKSGALNQVLPLTQGEIIAVFDADAQVASDMLLHVVPLFQREKVGAVQVRKAIANAKENFWTKGQMAEMSLDIWFQQQRTALGGIGELRGNGQFVRRQALDSCGGWNEETITDDLDLTFRLHLDKWDIECLFYPAVQEEGVTTAIALWHQRNRWAEGGYQRYLDYWDLILKNRMGTRKTWDMLMFMLTMYILPTAAIPDLLMALTRHRPPMLGPVTGLSVTMSVVGMFAGLRRIRQEQKFQVHTPFVLLLQTMRGTLYMLHWLVVMSSTTARMSFRPKRLKWVKTVHTGTGE

SEQ ID NO: 16331 - protein, 307 aa, Desulfovibrio vulgaris subsp. vulgaris (strain Hildenborough)
MPLTGPREMFARAYREGHAVGAFNVNNMEIIQGIMQAGAEERAPLILQVSAGARKYAGQNYIIKLIEAALLDTDLPVVLHLDHGQDFDICKSCIDGGFTSVMIDGSHLSYEENIAVTRRVVEYAHDKGVWVEAELGQLAGVEDEVSAEHSVYTDPDQAVEFVQRTGCDSLAIAIGTSHGAYKFTGDAKLDFARLETITKMLPDYPLVLHGASSVPQEFVEMANAYGGKVGGARGVPEDLLRKAATFGVCKINIDTDIRLAMTATIRKHFIENPGDFDPRAYLKPAREAVKNMVQHKIRNVLGCSNKI

SEQ ID NO: 16332 - protein, 444 aa, Bradyrhizobium elkanii
MTGICDSCTNSAAAAMIGVSDFDGILRGKHVLGEDLSVGNKVIKFSEAVLAWDCSDRVIPAGFTQEPQSVFGDADLRVLSGTGRSVSYAGDQYLYLAEFAGAHESVCPRGILRKVLQRVADRGYSCSAGFEFEFMLFKENADIIEDKPFGQWAPLTRGPFGYSIARSVAHRELFGEILALCEKSRIPLSGLHFETGPGVIEASLRHCDALEAADRAIIFKSMIKAWAQTRGMMATFMAKVSENWPGQSGHIHVSMSADGQNVFYDSEAFRNVSKLMRQFIGGQLKYMNDFCVLAVPNFNSYKRLVPGCWAPIYPSWGIDNRSCAVRVIPGDPSAHRLEYRLPGADLNPYLALACAIGSGILGIETNAALPASIVGDASAEACLPSGRLPQSLAEATYRFAQSPAANDVFGERFVEAFSCSRRWEWEAVQHRVTDFERRRYFEII

SEQ ID NO: 16333 - protein, 230 aa, Glycine max
  unsure (1)..(230): unsure at all Xaa locations
MKRDRDYELENGLALFGSDEELATQIPTQAQSLVEGSGSIRVAEFKPVPDVDYLQELLAIQQQGPRAMGLFGTXRTMGFMHQELIEILSYAMVITKNHIYTSGASGTNAAVIRGALRAEKPELLTVILPQSLRKQPPESQELLSKPCTFKFQQKAWEPLCNLQNYXVKNVIEKPHNDHLPLIEASRLCNMDIISHVQQVICFAFHDSRLLMETCQEAKNLRKIVTLFYLD

SEQ ID NO: 16334 - protein, 130 aa, Zea mays
  unsure (1)..(130): unsure at all Xaa locations
CLTWIASSIGVIPDFTKSWIMFQEISTXLLDPKVFRDTIDLFVXRHKDTMITAVAGDKLHXGFIFETPITLDIVAKIVSLRKSKKMPXEEISEKYALXYVTDQIQMHVGAVQVNYRALVVXELIATGATL

SEQ ID NO: 16335 - protein, 429 aa, Nostoc punctiforme
MKKVLSIILGGGAGTRLYPLTKLRAKPAVPVAGKYRLIDIPVSNCINSEIFKIYVLTQFNSASLNRHIARTYNFTGFNEGFVEVLAAQQTPENPNWFQGTADAVRQYLWLMEEWDVEEYLILSGDHLYRMDYRQFIQRHRDTGADITLSVIPIDERRASDFGLMKIDDSGRIIDFSEKPKGEALTQMQVDTSVLGLTKEQAQKQPYIASMGIYVFKKEVLFKLLRESVERTDFGKEIIPDASKDYNVQAYLFDDYWEDIGTIEAFYHANLALTQQPQPPFSFYDEHAPIYTRARYLPPTKLLDCQITESIIGEGCILKNCRIQHSVLGVRSRIESGCVIEESLLMGADFYQASVERQCSLIENDIPVGIGTDTIIRGAIIDKNARIGHDVKIVNKDNVQEAERENQGFYIRSGIVVVLKNAVIPDGTII

SEQ ID NO: 16336 - protein, 208 aa, Schizosaccharomyces pombe
LGTPIFEYLYWGGIEKGPNGKGHYPSGIRGLVNAASNIGNIFGQLMFGFMGDFFGRKFVYGKEMIIVIIATILLIAMPKSIHSPLSKMMWVFCWRWLLGVGIGGDYPMSAAITSERSKLNRRGTLISLIFAFQGFGTLAGAIVTIILLGCFEHPLNREGHYRKLEGVWRLQFGLALVPAIGVLIPRLMMEETQKFKNSQQLNSGDNRD

SEQ ID NO: 16337 - protein, 311 aa, Candidatus Tremblaya princeps
MVSSALQFLSQHSELSMDSARFLEALRFRPTHATTNPSLILSACQNNEYNSLVNETIRLHRNEGYRNIADHIRLRFCTELLDRIPGMVSVEIDACCAFNVDASIAHARRIVQLCRPTDARDRILVKIPATWQGVQAAAALRAEGVQCNMTLVFSMLQALVCARNGAYLISPFVGRLSDRMPAMQGSSATQDQGVALALRIYSRLRQEGHATRVMAASFRGEQQVIMASACGMVTVGEHIMRRLAAMRASAMPKPCQQFSEAMQHCPTPRDLHAFERALAQNRTAWLELKHGIEAFACNETQLELLIARRLP

SEQ ID NO: 16338 - protein, 900 aa, Eremothecium gossypii
MPPSPRPMLSTTTSNDLITGEQFRPRKLARRLTGFLPQEIKSIDSMIPLQSRELWKKHEVKKFGDSEEFQGKFIQHVETTLARSLYNCDEFAAYQAASESVRDNLVIDWNKTQQRITARDPKRVYYLSLEFLMGRALDNALINLNTSEEGDSTSREMVKASVEQLGFRLEDILEQEPDAGLGNGGLGRLAACFVDSLATGDYPAWGYGLRYQYGIFSQKIIDGHQVETPDYWLNFRNPWEIERSEIQVAVSFYGYVERAHGGSTLAPTEWIGGEQVLAVPYDMPVPGFNTSTVNNLRLWSAKPTTEFDFSKFNSGDYSNSVADQQRAESITAVLYPNDNFHSGKVLRLKQQYFWCAASLHDIVRRFKKTLRPWSEFPDQVAIQLNDTHPTLAIIELQRILVDLEHLDWHTAWDIVTKTFSYTNHTVMQEALEKWPVGLFGHLLPRHLEIVYDINWFFLQEVEKKFPKNVDLLARVSIIEESSPERQLRMAFLAIVGSHKVNGVAELHSELIKTTIFRDFVDIYGPSKFTNVTNGITPRRWLKQANPELAGLIADTLDDKDDSYLLEMSRLTKLANYADNPEFQRRWDDVKYHNKLRLANWLRDHNGGVDIIDRESIRDTLFDVQVKRIHEYKRQQLNVFGIIHRYLSIKDMLATGAALEEVRAAFPPRVCIFGGKAAPGYYMAKLIIRLINAVAAVINDDAAIGNLLKVVFIPDYNVSRAEIIIPASDLSEHISTAGTEASGTSNMKFVMNGGLIIGTVDGANVEITREIGEDNIFLFGNLAEDVEDLRYRHRYHRQELPAPIARVLETLSSGAFSPQDLREFQPLVDSVAQHGDYYLVSDDFDSYIACQALVDRVYHGDRRAWLQKSILSVANVGFFSSDRCIEEYAEMVWNVEAVKQE

SEQ ID NO: 16339 - protein, 147 aa, Rhizobium sp. NGR234
MTYRKTDEAVSKLTPEQYRVTQQNGTERPFTGEYTDNKRPGIYVDIVSGEPLFASADKFDSGCGWPSFTKPIVPANVNELRDASHGMIRTEVRSKHGDSHLGHVFPDGPEDRGGLRYCINSAALRFIPREEMEAEGYGAYINQVEDI

SEQ ID NO: 16340 - protein, 545 aa, Triticum aestivum
LPEALEKWSLDIMQKLLPRHVEIIETIDEELMNNIVSKYGTADISLLKQKLKDMRILDNVDLPASVAKLFVKTKMKKGKLLVESLESIAEADEKTEPEEEENILSETTEKKGESDSEEAPDAEKEDPEYELDPFAKYDPQLPRVVRMANLCVVGGHSVNGVAEIHSEIVKQDVFNSFYEMWPTKFQNKTNGVTPRRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDIGDLLKVVFVPDYNVSVAEKLIPASELSQHISTAGMEASGTSNMKFAMNGCILIGTLDGANVEIREEVGEENFFLFGAHAPEIAGLRQERAEGKFVPDPRFEEVKEYVRSGVFGTSNYDELMGSLEGNEGYGRADYFLVGKDFPSYIECQEKVDEAYRDQKLWTRMSILNTAGSPKFSSDRTIHEYAKDIWDISPVIMP

SEQ ID NO: 16341 - protein, 488 aa, Chordaria chordaeformis
MPEDVQNRTRIKSERYESGVIPYAKMGYWDADYNVKETDILALFRITPQPGVDPVEAAAAVAGESSTATWPVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 16342 - protein, 462 aa, Streptococcus agalactiae NEM316
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNTLTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 16343 - protein, 700 aa, Oryza sativa
MAPWSGLWGGKLAAGGGGGGGDHYRGTPVVVKMENPNWSISEISSPDDDDDEEFLVGGRRKGGRGKNAKQITWVLLLKAHRAAGCLASLASAAVALGAAARRRVAAGRTDADASAAAAAGESPVLRSRFYAFIRAFVVLSVLLLIVELGAYINGWDDLAASALALPVIGVESLYASWLRFRATYVAPFIQFLTDACVVLFLIQSADRLIQCLGCFYIHLKRIKPNPKSPALPDAEDPDAAYYPMVLVQIPMCNEKEVYQQSIAAVCNLDWPRSNFLVQVLDDSDDPTTQTLIREEVLKWQQNGARIVYRHRVLRDGYKAGNLKSAMSCSYVKDYEFVAIFDADFQPNPDFLKRTVPHFKDNDELGLVQARWSFVNKDENLLTRLQNINLCFHFEVEQQVNGIFLNFFGFNGTAGVWRIKALDDSGGWMERTTVEDMDIAVRAHLRGWKFIFLNDVECQCELPESYEAYRKQQHRWHSGPMQLFRLCLPDIIKCKIVFWKKANLIFLFFLLRKLILPFYSFTLFCIILPMTMFVPEAELPDWVVCYIPALMSLLNILPSPKSFPFIIPYLLFENTMSVTKFNAMISGLFQLGNAYEWVVTKKSGRSSEGDLISLAPKELKHQKTESAPNLDAIAKEQSAPRKDVKKKHNRIYKKELALSLLLLTAAARSLLSKQGIHFYFLLFQGISFLLVGLDLIGEQIE

SEQ ID NO: 16344 - protein, 358 aa, Acidithiobacillus ferrooxidans
MKKIAIFAGDGIGPEIVAAARQVLDAVDQAAHLGLRCTEGLVGGAALDASDDPLPAASLQLAMAADAVILGAVGGPRWDAYPPAKRPEQGLLRLRKGLDLYANLRPAQIFPQLLDASPLRPELVRDVDILVVRELTGDIYFGQPRGLEVIDGKRRGFNTMVYDEDEIRRIAHVAFRAAQGRRKQLCSVDKANVLETTRLWREVVTEVARDYPDVRLSHMYVDNAAMQLIRAPAQFDVLLTGNMFGDILSDEASQLTGSIGMLPSASLGEGRAMYEPIHGSAPDIAGQDKANPLATILSVAMMLRHSLNAEPWAQRVEAAVQRVLDQGLRTADIAAPGTPVIGTKAMGAAVVNALNLKD

SEQ ID NO: 16345 - protein, 302 aa, Zea mays; identical to SEQ ID NO: 11067

SEQ ID NO: 16346 - protein, 723 aa, Glycine max
MDFTSFLTSLGTSFVIFLVLMIVFAFLSSRPGNNVVYYPNRILKGLDPLEGGYKSRNPFSWIKEALTSSERDVIAMSGVDTAVYFVFLTTVLSILVLSGVILLPVLLPLSVTDHGMKTQTTSNGTFSELDKLSMANITAKSSRLWGFFIACYWVSIVTFALLWRAYKHVSWLRAEALKSPDVKPEQFAIVVRDIPHVPQGQTRKEQVDSYFRDIYPETFYRSMIVTDNKVVNKIWESLEKYTKKLARAEAVYAGSKTTAKPEGTRPTNKTGFLGLVGKKVDTIEYCNEKINELEARLESEQKVTLREKQQDAAVVFFSSRVVAASASQSLHAQMVDTWSVFDAPEPNQLIWPNLKIKYFQRELRQYLVYFIVALTIFFYMIPITFISALTTLDNLVKYLPFIKPIVNIKALKTVLEAYLPQLALIIFLALLPKLLLFLSKFEGIPTESHAVRAASGKYFYFTVLNVFIGVTIGGTLFKAFKRIREHPTLDEISSLLAESLPGNATFFLTYVALKFFIGYGLELSRIVPLIIYHLKRKYLCKTEAELKEAWRPGDLGYGTRVPGDMLIVTIVFCYSVIAPVIIPFGALYFGLGWLVLRNQALKVYVPTFESYGRMWPHIHNRILASLILYQITMFGYFGTQKFYYTPLVLPLPILSLVFGFVCAKKFYPAFQHPALEVAANTLKEVPNMELIFGAYIPPSLRSEKIDGDRVEDALSQASRTTPV

SEQ ID NO: 16347 - protein, 488 aa, Corynebacterium efficiens YS-314
MTIRAAVSHPVGPSGRNPGTGQMRDAMQCGHGAGCGSRPPRCPRRPSIRGAVTHPRLTPWPPQKKYLFTGFKREQVFRFMVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 16348 - protein, 458 aa, Staphylococcus epidermidis ATCC 12228
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 16349 - protein, 306 aa, Lactobacillus plantarum WCFS1
MNTVTVIGSINLDRTIRVENMPKPGETIHTKEIFSAGGGKGANQAVAAQRSGANTHFIGAVGDDAAGKTMLDLLTQEKINLAGITKMTNQSTGQAYVTVDDAGENQIMIHGGANMAFTPADVEAHRDIIETSDFVVAQFESAVDSTVEAFKIAQAAGVRTILNPAPAMEKVPAELLAVTDMIVPNETETETLTGIAITDEVSMLKASAALHALGISAVIITIGSKGAFYDIDGRHGIVPAFKVEAVDTTSAGDTFIGAMSSVLNKDFSNLEDAIRYGNRASSIAVQRFGAQPSIPYKNEITAAEGK

SEQ ID NO: 16350 - protein, 364 aa, Lycopersicon esculentum
MAIENNDQSFFLDVLYCEEEEEKWGDLLEDEEGVIINPLLLSSEGTTKTNSLLLLPLLLLEQDLFWEDEELLSLFVKEKETRCCFESFGSDPFLCSARVDVVEWILKVNAHYDFSALTAILAINYLDRFLSSLQFQKDKPWMTQLAAVTCLSLAAKVEETQVPLLLDFQVEDAKYVFEAKTIQRMELLVLSSLKWRMNPVTPLSFLDHIIRRLGLKNNVHWEFLRRCESLLLSVMIDCRFVRYMPSVLATAIMLHVIHQIEPCNAIDYQNQLLGVLKISKENVNNCYELISEVSSKPITSHKRKYDENPSSPSGVIDPIYTSESSNDSWDLDLPSFKKSKVQEQQMKMSSSLSRVFVEAVGSPH

SEQ ID NO: 16351 - protein, 351 aa, Yarrowia lipolytica
MSAPVIPKTQKGVIFETSGGPLMYKDIPVPVPADDEILVNVKFSGVCHTDLHAWKGDWPLDTKLPLVGGHEGAGVVVAKGKNVDTFEIGDYAGIKWINKACYTCEFCQVAAEPNCPNATMSGYTHDGSFQQYATANAVQAAHIPKNCDLAEIAPILCAGITVYKALKTAAILAGQWVAVTGAGGGLGTLAVQYAKAMGYRVLAIDTGADKEKMCKDLGAEVFIDFAKTKDLVKDVQEATKGGPHAVINVSVSEFAVNQSIEYVRTLGTVVLVGLPAGAVCKSPIFQQVARSIQIKGSYVGNRADSQEAIEFFSRGLVKSPIIIIGLSELEKVYKLMEEGKIAGRYVLDTSK

SEQ ID NO: 16352 - protein, 466 aa, Zea mays
KTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 16353 - protein, 224 aa, Haemophilus influenzae Rd
MKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPAMPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 16354 - protein, 363 aa, Vibrio vulnificus CMCP6
MTDKTYKIAVLPGDGIGPEVMAQAHKVLDAIEKKHAIHFEREEHDVGGIAIDNHGCPLPQSTVTACEESDAVLFGSVGGPKWEHLPPNDQPERGALLPLRKHFQLFCNLRPAQIHSGLEAFSPLRADISGRGFDIVVVRELTGGIYFGQPKGREGEGANEKAYDTEIYHRFEIERIAKIAFESARLRRKKVCSIDKANVLQSSILWREVVEELAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIENAVSQALAAGELTADLAGDKPALSTAEMGDKIAQYILNS

SEQ ID NO: 16355 - protein, 364 aa, Escherichia coli O157:H7 EDL933
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDIELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 16356 - protein, 375 aa, Neurospora crassa
MVSLSWRTAVTTATAAFASVASAQTWTACNPTQRTDCSPNTALGMAIDVDFTQGAVNSFNPYGGTPSYSRNDGVSFTVAKSGDSPQLTSIFYIMFGRVEITMKAAPGAGIVSSVVLQSDDLDEIDFEWLGADNTYVQTNFFFQGKTASYDRGQFNPAPNSQGQFIKYTIDWTSEKISWYVGGTLVRVLTVNDAGGEYPQSPMQVKFGAWSGGDSANSPGTIQWAHGPTDYSQGPFSMTVKSVMVSDYSTGKSYRYGDTSGTWQSIIAEGGKVNGNLGKAGTVTVTASAVAATNTGSAGGSVPVGGIGSASGGSSGSNGGSGSSTHGSIPEGWVMKPDGKIVPVGAASAMARPPQGLLVATSLVTVALAAFVGCLA

SEQ ID NO: 16357 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEILEFHKSHGGEASIMVTKVDEPSKYGVVVMEESTGRVEKFVEKPKLYVGNKINAGIYLLNPSVLDKIELRPTSIEKETFPKIAAAQGHYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 16358 - protein, 522 aa, Oryza sativa
MAISLITSLLFSLPQQWQPVVLTGLLPVIVSLVLLARKGRLKMPPGPEQVPLLGNLHQLAGPQPHRALRDLARVHGPVMRLRLGKASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGTVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIGHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCLEEEGRLVCHRKTPLVLVPTVYRHGLE

SEQ ID NO: 16359 - protein, 365 aa, Thermobifida fusca
MEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRFARQG

SEQ ID NO: 16360 - protein, 178 aa, Zea mays; identical to SEQ ID NO: 3538

SEQ ID NO: 16361 - protein, 512 aa, Escherichia coli O157:H7
MTNNPPSAQIKPGEYGFPLKLKNRYDNFIGGEWVAPADGEYYQNLTPVTGQLLCEVASSGKRDIDLALDAAHKVKDKWAHTSVQDRAAILFKIADRMEQNLELLATAEAWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 16362 - protein, 496 aa, Glycine max
MIMMMMMCSMWMWVVLVAIAGALLVLRSILKNVNWWLYESKLGVKQYSLPPGDMGWPFIGNMWSFLSAFKSKDPDSFISSFVSRFGRTGMYKTMMFGNPSIIVTTPEICKRVLTDDDKFTPGWPQSTIELIGKRSFISMSYEEHKRLRRLTSSSINGMEALSLYLTYIEKNVKSSLEKWANMGQIEFLTEIRKLTFKIIMHIFLSSESEHVMEALEREYTALNHGVRAMCINIPGFAYHKAFKARKNLVAIFQSIVDERRNLRKGYLPGKAKDMMDALIDLEDDERKLSDEDIIDIMLMYLNAGHESSGHITMWATFFLQKHPEYLQKAKAEQEEIIRRRPSTQKGLTLKEVREMDFLYKVIDETLRVITFSLVVFREAKTDVNINGYTVPKGWKVLVWFRSVHLDPEIFPDPKEFNPNRWNKEHKAGEFLPFGGGSRLCPGNDLAKMEIAVFLHHFLLNYRFEQHNPNCPVRYLPHTRPMDNCLGRVRKCPSTTT

SEQ ID NO: 16363 - protein, 401 aa, Brassica napus
MALKLNPLASQPYKLPSSARPPISTLRSPKFLCLASSSSPALSSSTKEVESLKKPFTPPKEVHVQVLHSMPPQKIEIFKSMEDWAEQNLLTHLKDVEKSWQPQDFLPDPASDGFEDQVKELRERARELPDDYFVVLVGDMITEEALPTYQTMLNTLDGVRDETGASPTSWAVWTRAWTAEENRHGDLLNKYLYLSGRVDMRQIEKTIQYLIGSGMDPRTENNPYLGFIYTSFQERATFVSHGNTARQAKEHGDLKLAQICGTIAADEKRHETAYTKIVEKLLEIDPDGTVVAFADMMRKKISMPAHLMYDGRDDKLFDNFSSVAQRLGVYTAKDYADILEFLVGRWKIESLSGLSGEGNKAQEYLCGLTPRIRRLDERAQARAKKGPKIPFSWIHDREVQL

SEQ ID NO: 16364 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEATRIQYGGSVKPNNIKEYMAQTDIDGALVGGA

SEQ ID NO: 16365 - protein, 273 aa, Oryza sativa
MLRFLLVWSRMTEEATSGDASPPNVKTMSLIARQAFEIDEYVRISDILHKRFARFDRRQWREAYKALLLLEHLLTHGPRSVALEFQRDREVIEQMVSFQHIDEKGSVSILRPDSIISSPDVLSPFFLITDGFFLNPSCSFNWGMTVKSKSERVLRLLERGPFLEDERERARKIAHEIKGFGSFNLSSAHASGSAAAALRAGAMEHQCYGRSNSRYEGRWRREACVDDGDKENLLVVSMAEAKAEAAAEEPHHYHHPFYGFGQQRPEAMLLLSQ

SEQ ID NO: 16366 - protein, 317 aa, Eucalyptus botryoides
MGSLEKERTTTGWAARDPSGVLSPYTYSLRHEVVGEVLEVGSEVTKYRVGDRVGTGIVVGCCRSCGPCNSDQEQYCNKKIWNYNDVYTDGKPTQGGFAGEIVVGQRFVVKIPDGLESEQDAVMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 16367 - protein, 463 aa, Chondracanthus chapmanii
MGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAIKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAAAGETKGHYLNVTAATMEEIYERAEFAKELGSIIVMIDLVIGYTAIQTMAIWARKNDMILHLHRAGNSTYSRQKIHGMNFRVICKWMRMAGVDHIHAGTVVGKLEGDPLMIKGFYNTLLLPYLKVNLPQGIFFEQDWASLRKVTPVASGGIHCGQMHQLLDYLGDDVVLQFGGGTIGHPDGIQAGATANRVALESMVIARNEGRDYVSEGPQILQDAAKTCGPLQTALDLWKDITFNYTSTDTADFVETPTANV

SEQ ID NO: 16368 - protein, 716 aa, GIBBERELLA ZEAE PH-1
MVSSKLLVVLGLASLTAAQCPYADPAKLAARDEGSSREHLKDYEVDDSKGHMSSDAGGPFEEQESLKAGERGPTLLEDFIFRQKITHFDHERVPERAVHARGAGAHGYFKSYSDWSNITAASFLSSKDKNTPVFVRFSTVAGSRGSADTVRDVHGFATRFYTDAGLFDIVGNNIPVFFIQDAIQFPDLIHAVKPSPDSEIPQAATAHDSAWDFFSQQTTTLHTLFWAMAGYGIPRSFRHVDGFGVHTFRLVTDEGDTKFVKWHWKSKQGKASLVWDEAQHLAGKNADYHRADLWNAIESGNGPEWELNAQIFDEDQALAFGFDVLDATKIIPEELAPLQPIGVMKLDTNPVNYFAETEQVMFQPGHIVRGIDFTEDPLLQGRIFSYLDTQLNRHGGPNFEQLPINRPLSPIHNNNRDGAGQNFIHKNTAASDSLDTPNTLNKGYPVQANQTQGKGFFTAPGRKVSGNLVRARASTFSDHWSQPRLFYNSLTKVEQQFLINAIRFETSQLMSETVQKNVLYQLNKISHDIAVRVGRALGLKAPEADDKYYHDNTTAGISIFGTKLPSIATLSVGVLVSINSNNSIQQAKALKKALGEDKVTVSIIGEVLGDDVEVTYSAATAAQFDSVVVTSGTESLFNGTGKSTLFPPGRPTQIIVDGYHWGKPVGFIGGAKAAAQAARVSKGKGVYFPKNVNSLVEDLKDGLATFKFTDRFPLDH

SEQ ID NO: 16369 - protein, 662 aa, Papaver rhoeas
MASITTNLKNPLPLSSSFNSSKPLFSKSNLLSIPTKFISSRPLHITNSSYRNQSNKPKAITTETPISTTHTTSVSPPPFVSRYKDDEPRKGADVLVEALEREGVTNVFAYPGGASMEIHQALTRSSSIRNVLPRHEQGGIFSAEGYARASGLPGVCIATSGPGATNLVSGLADALLDSIPIVAVTGQVPRRMIGTDAFQETPIVEVTRSITKHNYLVLDVEDIPRVVKEAFFLATSGRPGPVLIDVPKDVQQQLVVPKWDTPMKLPGYMSRAPKSPEHNLLEQVVRLISESKKPVLYVGGGCINYSEELRRFVDLTGIPVASTLMGLGAHSCTDVLSLQMLGMHGTVYANYAVDKADLLLAFGVRFDDRVTGKIEAFASRSKIVHIDIDPAEIGKNKQPHVSICADMGVALKGLNKLLEEKMSKLKLDFVSWREELMEQKKNYPLSYKTFGEAIPPQYAIKVLDELTEGKAIISTGVGQHQMWAAQWYKYRGPRQWLTSAGLGAMGFGLPAAIGAAVAKPEAIVVDIDGDGSFMMNVQELAAVRVENLPVKILLLNNQHLGMVVQWEDRFYKANRAHTYLGNPAKDTEIFPDMLKFAEACDIPAARVTKVSELRAAIQKMLDTPGPYLLDVIVPHQEHVLPMIPAGGSFNEVIIEGDGRTKY

SEQ ID NO: 16370 - protein, 375 aa, Solanum tuberosum
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 16371 - protein, 396 aa, Oryza sativa
MAAAEERDAAAASSLAEFHASRAGVRGLVESGATAVPPLFLPPGCGRERSTPPTPPRATAFAIPTVDLSLPRSATVPLVRAAATSCGFFHVTSHGVPRGTVASAVAAVRAFHEQPAASRSPCYSLAPVGGVAYSTIPIQQPPPQDGSSSDHRAATAASPLLPWRDSLVVRFGPGPEAPDLGRLPASCRDALPEYQRSLTVFGKEMAGLLSEALGGGGGGGGVGAERLEREMQVEGWLMACHYYPPCPEPERVVGSLEHTDPSLFTVLAQDAVGGLQVRREEEEGGGGGGEWVDVAPVAGALVVNVGDVLKMVSNEEYKSVEHRVVIKSSQDARVSIAVFFNPAKRDASDLFGPLPELLTAERPARFRRFSVPEFMRSRRESGHGKSSIDSFRIAAD

SEQ ID NO: 16372 - protein, 349 aa, Nitrosomonas europaea ATCC 19718
MTIKAYGARAGDLPLEPMNITRRTPSAHDVQIDITHCGVCHSDLHQVRSEWAGTLYPCVPGHEIVGRITAVGAQVSGYKPGDLVGVGCIVDSCQHCADCNDGLENYCDHMVLTYNGPTSDAPGHTLGGYSQQIVVHERYVLRIRHSEAQLAAVAPLLCAGITTWSPLRHWKVGPGQKVGVVGIGGLGHMGIKLAHAMGAYVVAFTTSESKREAARALGAHETVVSRNPDEMARHVGSLDFILNTVAASHDLDAFFALLKRDGTMALVGAPATPHPSPNVFNLIMKRRSLAGSLIGGISETQEMLDFCAKHNIVADVEMIRIDEINEAYERMLKGDVKYRFVIDCASLTA

SEQ ID NO: 16373 - protein, 291 aa, Streptomyces avermitilis MA-4680
MELGLVGLGKMGGNMRERIRRAGHTVIGYDRNPDVADVHSLEELVGKLKGPRVVWVMVPAGAATQSTVDELGELLEPGDIVVDGGNSRWTDDEKHAEELAAKGIGFVDCGVSGGVWGLQNGYALMYGGDAENIAKVQPIFDALKPEGDFGAVHAGKVGAGHFSKMVHNGIEYAMMQAYAEGWELLEKVDSVTDVREVFRSWQEGTVIRSWLLDLAVNALDGDEHLEKLRGYAEDSGEGRWTVEAAIDNAVPLPAITASLFARFASRQDDSPQMKMIAALRNQFGGHAVEKK

SEQ ID NO: 16374 - protein, 537 aa, GIBBERELLA ZEAE PH-1
MSTKQFYLLGEVVSTARDIELPPAVDFEELQSVGFIHDGRKLNAVSEILEVNESIAISVDGNAVRDVPGPAGIPYFGNYLEIYPDHLGNHQRLFEKYGPLFTTTSMGNRLYQTNSAELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADNVVDYFLRATDNKGNKLPPSQFAPALLVATAAGFTTTSSLLSWLIYSLVKYHGNQERLLQELIDNDWDENTQVTADTTSKLTFLDKFIKETQRLHNPSFQPGRTAKVDMILPGGYRLPKGAVVISALHHMHNNKDVWENPGRFDPDRWDTEQVKNRPPGSYIPFATGPRMCVGFNFALQEIKVFLPKLVYRYKFSLAQDGPIEYDPYFQLIRPNNLYVQAEKRVKWPPKSE

SEQ ID NO: 16375 - protein, 345 aa, Glycine max
MAFHDHLQHEIAFQRFTEEQELNENRDMQQRLPPPTWLNNVNARQQNFLDTEKSVDRNNRSESNCESEDLREYKADILGHPLYDQLLSAHVSCLRIATPVDQLPRIDAQLQQSQRVVEKYSALAHNGVVDEKELDQFMTHYVLLLCAFKEQLQQHVRVHAMEAVMACWDLEQSLQSLTGVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKSSAGEASNQSFM

SEQ ID NO: 16376 - protein, 197 aa, Brassica rapa
MGRKKLEIKRIENKSSRQVTFSKRRSGLIEKARQLSVLCDASVALLVVSSSGKLYSFSAGDNLVRILDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 16377 - protein, 228 aa, Zea mays
MLFLHCQSCIPSRPRPRRPTPPFRPRVSVAAPLSVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRNKLGDRPVFVLVEADA

SEQ ID NO: 16378 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 16379 - protein, 490 aa, Comamonas testosteroni
MKQYRNYINGEWVESARRFDDVNPVDGTVVAQVHEADREAVDSAIRAGHAAVRGAWGRTTVAERAAILCRIADEIDRRYDDFLAAEIADTGKPVAMASTIDIPRGAANFRVFADILKTAPLDTFQTDLPDGARALNYAVRKPLGVVGVISPWNLPLLLLTWKIAPALACGNAVVAKPSEETPGTATLLAEVMHTVGVPPGVFNLVHGFGPDSAGEFITTNDDIDAITFTGESRTGSAIMRAAATHVKPVSFELGGKNAAIIFADCDFEKMIDGMMRAVFLHSGQVCLCAERVYVERPIYNRFLDAFVERVKALKLGWPQDGTTGMGPLISAEHRDKVLSYFKLAREEGAQVLVGGGVPKFGDARDAGFWVEPTIITGLPQTARCIKEEVFGPICHVSPFDTEAEAIALANDTKYGLSATTWTGNLNRGHRVSEAMRVGLSWVNSWFLRDLRTPFGGVGLSGIGREGGMHSLNFYSELTNVCVRIDQEAVS

SEQ ID NO: 16380 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 16381 - protein, 348 aa, Cytophaga hutchinsonii
MAFSLDSILRDNIKNAKPYSSARDEYKGTEGIFLDANENPYGSAIQKMVNRYPDPLQRDVKTALSALKNVSAEHIFFGNGSDEPIDLLIRATCQPGKDSILILPPTYGMYEVSAGINDVDIISVPLTKAFDLDVDAILAAVKTHTKIIFICSPNNPTGNLMSEDKVKRILNAFSGIVVVDEAYIDFADTKGFVPLLDQYPNMVVLQTFSKAWGMAALRLGTAFASKEIVSVLNKIKPPYNINLLTQEAALEALQNVSVKDEMVYKILKQRDWLREELSKLPVCLELYPSDANFILMRTADGKKVYDYLVEHIVITRDRSKIILCEGCVRITVGTEAENKRLLDVLKTY

SEQ ID NO: 16382 - protein, 196 aa, Mitthyridium sp. Mishler 7/21/98
GGAKKVVISAPSKDAPMFVMGVNEEKYTNEDIVSNASCTTNCLAPLAKVINDKFGILEGLMTTVHATTATQKTVDGPSNKDWRGGRSAGSNIIPSATGAAKAVGKVLPELNGKLTGMAFRVPTTDVSVVDLTVRLEKPASYDAIKAALKEASQGKMKGILGYTEDHVVSSDFITDSQSSLFDAKAGIALSDTFVKL

SEQ ID NO: 16383 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 16384 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 16385 - protein, 322 aa, Xanthomonas campestris pv. campestris str. ATCC 33913
MTASPSKLAQLRDLSVVVADTGDYDAIKRLKPVDCTTNPTLVKKALDLPVYADLIERELAWGRAHGGEDRNSTINEVADRLTVGVGTMLSELVPGRVSTEVDADLAHDTQATIAKARKFIAMYAERGVSKDKILIKIAATWEGIEAARQLQQEGIDCNLTLIFNRSQALACAEAGVFLISPFVGRILDFFVAKGQTPASIDEDPGVVFVRGVYDEFKRRGSSTVVMGASFRSTAQIEALAGCDRLTISPDLLEKLDADHGDLPRKLSPLNADNAAITPINSDSFATDLAADDMATEKLASGIDTFAKDLEALRKTIADKLAG

SEQ ID NO: 16386 - protein, 320 aa, Brassica rapa subsp. rapa
MEENIKPPVIDLSKLNDEERDQTMALIDDACQNWGFFELLNHGIPYDLMDNIERMTKEHYKKFMEQKFKEMLRSKGLDTLETEVEDIDWESTFFLHHLPQTNLYDIPNMSDEYRTAMKDFGKRLENLTEELLDLLCENLRLEKGYLKKVFRGTKGPTFGTKVSNYPPCPNPEMIKGLRAHTDAGGLILLFQDDKVSGLQLLKDGDWVDVPPLKHSIVINLGDQLEVITNGKYKSVMHRVMTQKEGNRMSIASFYNPGSDAEISPAQSLVDKESEYPSFVFDDYMKLYSGVKFQPKEPRFEAMKNAAVTTDVNPVATEETF

SEQ ID NO: 16387 - protein, 252 aa, Haloferax volcanii
MQGQAQQQAYDRGITIFSPDGRLYQVEYAREAVKRGTASIGVRTPEGVVLAADKRSRSPLMEPTSVEKIHKADDHIGIASAGHVADARQLIDFARHQSQVNRLRYGEPIGIETLTKEVTDHIQQYTQVGGARPFGVALLIGGVENGTPRLYETDPSGTPYEWKAVSIGADRGDHQEHLEENFRDDLTLDEGIELALEAIASTSDEGTAPDGVDVATVSAETERFVELSNDEIESYLEANDLLATEDDEQTEE

SEQ ID NO: 16388 - protein, 308 aa, Xanthomonas campestris pv. campestris str. ATCC 33913
MSYATHADTQLPHVGMHCSGMTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRVPDVHLDVAAVKGNAVFFSYDRPHPMTRTLHAGAPVLAGEKWVATKWLRERPLHAPT

SEQ ID NO: 16389 - protein, 214 aa, Oryza sativa (indica cultivar-group)
ENKMNRQVTFAKRRNGLLKKAYELSVLCDAEVALIIFSTRGRLFEFSTSSCMYKTLERYRSCNYNLNSCEASAALETELSNYQEYLKLKTRVEFLQTTQRNLLGEDLVPLSLKELEQLENQIEISLMNIRSSKNQQLLDQVFELKRKEQQLQDANKDLKRKIQETSGENMLHIFCQDVGPSGHASEANQEFLHHAICDPSLHIGYQAYMDHLNQ

SEQ ID NO: 16390 - protein, 499 aa, Brassica oleracea
MGKVAVGATVVCAAAVCAATVYVVRRRMKSCGKWGRVIEILKVFEEDCATPIGKLRQVADAMTVEMHAGLASEGGSKLKMLISYVDNLPSGDEQGFFYALDLGGTNFRVMRVLLGGKQDRVVKQEFEEVSIPPPLMTGASDELFNFIAEALAKFVATEGEDFHLPAGRQRELGFTFSFPVKQTSLCSGTLISWTKGFSIEDALGQDVVGELIKAMERVGLDMNVTALVNDTVGTLAGGRYYNSDVVAAVILGTGTNAAYVERANAIPKWQGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGETTQKSVIAMDGGLFEHYTQFSECMESSLKELLGDEASESVEVIHSNDGSGVGAALLAASHSQYLEDSETS

SEQ ID NO: 16391 - protein, 70 aa, Glycine max
  unsure (1)..(70): unsure at all Xaa locations
SITTGNRSGTSMVAPFTGTKSMADFCIRNTNDDITIIASNGAXVQCMHMWTPVSMKQIDTDSYLPDIDHA

SEQ ID NO: 16392 - protein, 365 aa, Bradyrhizobium japonicum USDA 110
MSCPVPNPGILDIAPYTPGKSPVPEPGRKVFKLSANETPFGPSPKAIEAFKKVADHLEDYPEGTSRVLREAIGRTFGLDPNRIICGAGSDEILNLLAHTYLGQGDEAISTTHGFLVYPIATMAVGARNVIAQEKNLTCDVDAILKAVTPKTKLVWLANPNNPTGTYIPFDEVKRLRAGLPSHVLLVLDAAYCDYVSRNDYEMGIELVATTENTVVTHTFSKIHGLAALRIGWMFGPEHIIDAVNRIRGPFNVSTPAMYAAVAAIEDTAHQAMSKQFTETWRNWLTEEIGKLGLKVTPSVANFVLIHFPTDRGRTSDDADAFLTKRGLVLRALKNYGLPHSLRMTIGTEEANRLVVDGLRDFMAGK

SEQ ID NO: 16393 - protein, 512 aa, Oryza sativa
MHAAHGGGGRQPVTILPISSSQLVVTGGDWPLLAYLEKALMALEAVVFPQEHLSCAAAMYAAPPSSLGCGVDMDEFEENGGVVLQEEAGVAVHGGGGGGAGGMMSLWVNAATCARSIAASGAVEEFWDERQYPVSSPPAAPTPAASGGGGGHAKAAARRRRRRPKVVKNKEEAESQRRNHIAVERNRRRQMNEYLAVLRSLMPPSYAQRGDQASIVAGAINFVKELEQLLQSLEAQKRRAEHAPPAPPFAGFFTFPQYSTTVGDNNAAGSGAADGEGGCGARPGAADIEVAMAESHANVRVLAPRRPRQLLRMVVALQCLGLTVLHLNVTTTADHLALYSFSLKMEDECRLSSVDEIAGAVNQMMSESEDEKSLSDEITDTSHLPWDPFWTRKCKYPSGGRSDNGWQRTEGWRAVGGASAGRRRGAAGGSEASAGRWVEQWGGRWKWSVGGAVGRATAGTRGGGRSERSGARRREIGETAGGREEHRAVGLPSSPSVIRGEEMGWKRGRSEQ

SEQ ID NO: 16394 - protein, 136 aa, Trichodesmium erythraeum IMS101
MSMVTKQISDKTYHRRLIMSENKDSKGKGFGFGLGKMKELTEAFKKAQEVQEGAKKLQEELEQLEVEGSAGEGLVKVFMSGNQQPKRVEISPDVLKEDANRVNQLVTEAMQDAYKKSTTTMRERMEELTGGLNLPG

SEQ ID NO: 16395 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKRPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 16396 - protein, 245 aa, Glycine max
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLERADAEVVECACVIGLSDLKVRCKLNGKPLYILVEPRQVENGFWSGNSNCTLHMKKWLHINDPLENSTIVFCLESHNENTQDFKHPYPMEAPFC

SEQ ID NO: 16397 - protein, 343 aa, Geobacter metallireducens
MWQSPGGLRQRRVPSATVSTSWPWEGKSLFRTSWPDYETKTSNKIENARSAPMQVKKAVFPVAGLGTRFLPATKASPKEMLPLIDKPLVQYVVEEAVAAGIEQILFVTGRGKRAIEDHFDISFELEALLQEKGKNDTLREVRDIAEMVNIFYVRQKQAMGLGHAILCAREFVGNEPFAVLLGDDIIDAEKPCLGQLLDVYRKYRGPVLALEKVPMENISSYGCVRANGITDRIFEVTDLVEKPKREEAPSDMAIIGRYVLTPEIFPILERQEPGKGGEIQLTDALLKLSKDEAIYGCLFEGIRHDCGDKLGFLKATVDMALKREEFNTEFEEYLRERLCRRQD

SEQ ID NO: 16398 - protein, 485 aa, Pseudomonas putida
MPDVRGALLIGGKARAASDGGTFERRHPVSGEVVSVVAAATLADADAAVEAAQAAFPAWAALGPGERRARLLKAADALDARRDEFLAMAGETGAKANWYGFNVMLAANILREAASMTTQIQGSVIPSDVPGSFAMALRQPCGVVLGIAPWNAPVILATRAIAMPLACGNTVVLKASEASPAVHGLIGQVLQAAGLGDGVVNVICNAPHDAPAVVERLIAHPAVRRVNFTGSTHVGRIVGQLAARHLKPAVLELGGKAPFLVLADADLEAAAVDAAAFGAYFNQGQICMSTERLIVDQAVADEFVAKLGEKVRRLRAADPSQPDAPLGSLIDAGAGERIQALVDDAVGKGATLVAGGERTGSVMQPVLLDHVNAGMRLYREESFGPVAVVLRASGDEALLALANDSEFGLSAAIFSRDTQRALALAQRLESGICHINGPTVHDEAQMPFGGVKASGYGSFGSTAAIDAFTQLRWVTVQHGARHYPI

SEQ ID NO: 16399 - protein, 397 aa, Chlamydophila pneumoniae CWL029
MRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 16400 - protein, 303 aa, Prochloron didemni
RIGRNFLRCWAGRENSQLDLVGINDTSDPKTNAHLLKYDSMLGIFDGDVDADENSLIVNGKTIKCVSDRNPLNLPWADWGIDLIIESTGVFVTEEGASKHLTAGAKKVLITAPGKGGNIGTYVVGVNEKDYEHHKHNVVSNASCTTNCLAPFAKVLNDTFGIVKGTMTTTHSYTGDQRLLDASHRDLRRARAAAINIVPTSTGAAKAVALVVPELKGKLNGIAMRVPTPNVSVVDLVVQVEQGCIKEQVNDALKAAAEGPLKGILRYNDLPLVSCDYRGTDCSSIVDGSLTMVMGGDMVKVVA

SEQ ID NO: 16401 - protein, 436 aa, Magnetospirillum magneticum
MELHHPELTYAAIVGLAAVLCGGMMTRLKQPAVVGYILAGVVLGPSGFGLVSNRDAVATLAEFGVLMLLFVIGMKLDIIRFLEVWKTAIFTTVLQIAGSVGTALLLRHGLGWSLGLAVVLGCAVAVSSTAVVIKVLESSDELDTPVGRTTLGILIAQDMAVVPMMLVLESFETKALLPADMARVVLSVLFLVLLFWWLSKRRIDLPITARLSRDSDLATLSTLAWCFGTGAISGVLDLSPAYGAFLGGVVLGNSAQGDMLLKRAQPIGSVLLMVFFLSIGLLLPFKVIWKKLGTSFTRVRTREPFKTPLNVTALPLARQDWPNASLAGVALAQIGEFSFLLAETGKAVKLISAQETKLVVAVTVLSLGLSPFWLFTMRRMHRVAAVHVHSFRDLVTRLYGDEARAFARNARRARVLVRRGSWRDDPNAGPGSGIST

SEQ ID NO: 16402 - protein, 239 aa, Eremothecium gossypii
MSDDKRLKEFQEQNKIVFDHSTRSVWENQDKDSSMGHLMGGSVVQSESKDSMDADHGTTSGIVPTLQNIVATVNLDCRLDLKTVALHARNAEYNPKRFAAVIMRIREPKTTALIFASGKMVVTGAKSEDDSKLASRKYARIIQKIGFSAKFTDFKIQNIVGSCDVKFPIRLEGLAFSHGTFSSYEPELFPGLIYRMVKPKIVLLIFVSGKIVLTGAKQREEIYQAFEAIYPVLSEFRKL

SEQ ID NO: 16403 - protein, 564 aa, Brucella melitensis 16M
MHIMTSKPNVRTGGQILVDALRIHGADRVFCVPGESYLAALDAFHDASDAIDLIVCRQEGGASYMAEAYGKLTGKPGICFVTRGPGATNASIGVHTAFQDSTPMLLFIGQVASDQVEREAFQEIDYRRMFGQMAKWVVQIDDAARIPELVSQAFHRAVNGRPGPVVVALPEDMLTSYAAVSDAPAYKQVAMHPGGEQLQAMRALIEKAERPLMIVGGGGWTQDAVRDLRQFAENMSLPVAASFRCQDMFDNTHPLYAGEMGTSISARLVQRVKDSDLLVVVGARLGEMTTQGYELVTIPVPQQKLVHIHPGAEELGRVYHADVPINAGMPAFCAAAAKLAPVADPRWKAWADSANADYRDNIKSPVISGEVQMGEVMEWLRAHLPADAIITNGAGNYSAWPHRFYQYRTYRSQLAPTNGSMGYGVPAAVAAKLTAPERTVVAFAGDGCFLMNGQELATAAQYGANAIFIVVNNGMYGTIRMHQERTYPARISGTALANPDFAALARAYGLHGEVVEKTADFAPAFKRCEQSGKPALIEIRIDPEALSPKMSLSQMREQGFAKQR

SEQ ID NO: 16404 - protein, 464 aa, Gelidium pusillum
  unsure (1)..(464): unsure at all Xaa locations
KMGYWDPDYVVKETDVLALFRITPQPGVDPVEASAAVAGESSTATWTVVWTDLLTACDLYRAKAYKVEAVLNTSDQYFAYISYDIDLFEEGSIXXXXXXIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKXXXXXXXXXXXVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGIDVVLQFGGGTIGHPDGIQAGATANRVALEAMVMARNEERDYVAEGPQILRDAAKTCGPLQTALDLWKDITFNYTSTDTADFVETPTANV

SEQ ID NO: 16405 - protein, 226 aa, Crocus sativus
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLG

SEQ ID NO: 16406 - protein, 423 aa, Rhodobacter sphaeroides
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 16407 - protein, 324 aa, Vibrio parahaemolyticus RIMD 2210633
MKVIDAQQVAQSLSMHSLIETMRDIYAQPATIPQRRVMSLEEGKYEAFALLPAWNQELIAVKAFTYFPENPLQGKDTLASKLLVFKRGDGEPIALVDGKVLTFWRTAAASALAADYLARKNASRLLICGTGNLAPYFAWAYAAIRPLKQVYVWGRNPEKAAATVDQILSSSEYQSLPEERQFSVSVVENVEQVIDQVDIISCITASAQPLFNGSDVQPGTHIDLVGNHDLDKRECDSVSVQRANVYVDSRINVLAEAGDLLIPIQEGVFTPEDIYGELPELCAQQVQGRQSDEVITLYKSVGSALADLAAVKAVLLKHGVESQI

SEQ ID NO: 16408 - protein, 363 aa, Prochlorococcus marinus str. MIT 9313
MSQKTSVSSGQTTANPLAAGRHGERISTLISSKRAKVDRQIGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSQEHHLLGGFAFIGEGIPIALGAAFTSRYKRDALGDASSNAVTAAFFGDGTCNNGQFFECLNMAQLWQLPILFVVENNKWAIGMAHERATSEPEIWQKAAAFGMAGEEVDGMDVLAVRAATQRAIKRARAGEGPTLLECLTYRFRGHSLADPDELRAEEEKQFWAKRDPLKALEKDLTSESLVRAEELRAIEKEIDAEINDCVEFALAAAEPNPNELTRYIWAED

SEQ ID NO: 16409 - protein, 340 aa, Prochlorococcus marinus subsp. pastoris str. CCMP1378
MKIGINGFGRIGRLVFRALWDRADTEITHINEMAGDSNAAAHLLEFDSVHGRWVKDIKVKEEEIIIDGKKLAYTSFKNYLDVPWEKSSVDIILECTGKNKKPDKLNPYFDSLGMKRVIVACPVKGIVAEAESLNIVYGINQNLYDPSKHKLVTAASCTTNCLAPIVKVINENFSIKHGAITTIHDVTNTQVPVDFYKSDLRRARGCMQSLIPTTTGSAKAIAEIFPELKGKLNGHAVRVPLLNGSLTDAVFELNNAVTEEQVNNEFKKASETYLEGILGYEERPLVSADYVNDSRSSIVDSLSTMVVNSNLLKIYAWYDNEWGYSCRLADLTEYVIKKEI

SEQ ID NO: 16410 - protein, 94 aa, Agaricus bisporus
SAPPGQVPLKKKAHFREALAYFSEWRHLRLIMGTASCWFLLDIAFYGINLNQNVVLQQIGFDGSSGSAWNRLFKISTGNIIITALGFVPRPRPR

SEQ ID NO: 16411 - protein, 469 aa, Porphyra aestivalis
  unsure (1)..(469): unsure at all Xaa locations
VIXYAKMGYWDADYXIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 16412 - protein, 111 aa, Triticum aestivum
  unsure (1)..(111): unsure at all Xaa locations
SATSVATFQGXKSTAGLPVSRRSNGASLGSVSNGGRIRSMQAWPIEGIKKFETLSYLPPLSTEALLKQDHYLIRSKRGPRLEISKAGHIFREHNASPGYYEGRDWTTGKLP

SEQ ID NO: 16413 - protein, 311 aa, Staphylococcus intermedius
GFGRIGRLAFRRIQNVEGIEVVAINDLTDAKMLAHLLKYDTTQGRFDGEVEVHDGFFKVNGKEVKVLANRNPEELPWGELGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPSLKGKLDGAAQRVPVPTGSLTELVTVLNKKVTVDEVNAAMEAASDPETFGYTNDAIVSSDIKGMTFGSLFDETQTKVLTVGDQQLVKTAAWYDNEMS

SEQ ID NO: 16414 - protein, 213 aa, Oryza sativa
MARTAWRCALVILTGVLLCAAVETAVAAKRVSIPDDLRDVVDDEEDDDWRHWGAAAPPRDDGQPPDLAGMDPAALQAELLRRHAGPSFGFVKLRLGVRRSQEEVMGIATRWTNVLRTGSVAAKFVAVDFGTLMFTMDTGQDILESSDNWVTLFKVKEFILSQPEAYEFKIGNQAFRRPGDPPLDEVVEMLQKQKSTMLSQDPGSQQYKSKVEL

SEQ ID NO: 16415 - protein, 369 aa, Triticum aestivum
MAMMVDPPNGMGNHGKHYYTMWQTMFEIDTKYVPIKPIGRGAYGIVCSSINQETNEKVAIKKINNVFDNRVDALRTLRELKLLRHLRHENVIALKDIMMPIHRRSFKDVYLVSELMDTDLHQIVKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSETDLAFIDNPKARNYIKSLPYTPGMPLSSMYPHAHPLAIDLLQKMLVFDPSKRISVTQALEHPYMSPLYDPSANPPAQVPIDLDIDENIGTDMIREMLWQEMLQYHPEAARMVNM

SEQ ID NO: 16416 - protein, 256 aa, Oryza sativa (japonica cultivar-group)
MDGGYGSVTIVHDARSPEDVFQDFCGRRSGIVKALTIEVEKFYKQCDPEKENLCLYGLPNGTWAVTLPADEVPPELPEPALGINFARDGMQEKDWLSLIAVHSDSWLLSVAFYFGARFGFDKKARERLFMMTSSLPTVFEVVSGGVNTQSKTANGSSKNKSGSKPPKRPNSDSKPQKQVQAKYEEENGGRGNGGDEDQAETICGACGEAYANGEFWICCDICETWFHGKCVRITPAKAEHIKHYKCPGCSNKRTRE

SEQ ID NO: 16417 - protein, 565 aa, Salmonella typhimurium LT2
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 16418 - protein, 431 aa, Schizosaccharomyces pombe
DRLNWILEKYFTYLRPSWLKKLGTRRAYELIKIEDQNTDYSCIGPVNAAMNTVCVYFHEGPSSKAFQKHIQRLHDFMWVQPEGMLMRGTNGLQVWETSFTLQALVESGLYEKEAFKPDIAKALEFLDRQQIRTQYEGSGYRYNSLGAWPFSNITQGYTVSDTTSEALRAVLLVQSLPDFEKLVDIPRLRLSVDVILGMQNENLGFASYEPARTGEWMELLNPAEVFGNIMVEYSYPECTTSVILALRAFTKYDPGYRRDEIENTIENALEYVVKMQRPDGSWYGSWAICFTYAAMFATGSLASAGRYYENCPVQKKACEFLLSKQRPDGGWSESYMACVTGVYTETESSLVTQTGWALDALINAKYPDRKPIEKGIKFLMASQKSDGSWQQKSMEGIFNKNVAIAYPNYKLYFSIYTLGKFAKQYGNYLTI

SEQ ID NO: 16419 - protein, 156 aa, Zea mays; identical to SEQ ID NO: 12580

SEQ ID NO: 16420 - protein, 411 aa, Streptomyces coelicolor A3(2)
MHSAVLLIEFGSIILGLGLLGRFAGRYRLSPIPLYLLAGLAFGEGGLLPLGASEEFVATGAEIGVILLLLMLGLEYTASDLVTNLKSHYPAGLVDCALNAVPGAVAALLMGWGPVAAVVLAGVTWISSSGVIAKVLGDLGRVGNRETPVILSVLVLEDLAMAVYLPIVTALVAGAGLMTGSITLAVALAAAGLVLFVAVRYGRLISRFVSSDDPEKLLLVVLGLTILVAGVAQQLQVSAAVGAFLVGIALSGEVAEGAHTLLSPLRDLFAAVFFVFFGLHTDPASIPPVLLPALALALLTAVTKIATGYWAARRAGISVKGRWRAGGALVARGEFSIVIAGLAVSAGIEPSLGPLATAYVLILVVLGPLTARFTEPLAMRLFPRRDNPDRPSGLAEGTPRAAATEEASVGD

SEQ ID NO: 16421 - protein, 336 aa, Zea mays
  unsure (1)..(336): unsure at all Xaa locations
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDAXDEXNVLSLWFDGLKLLVVTDGDKGCRYFTKDFKGSVSGFKVDTVDTTGAGDAFXVGSLLVNVAKDDSIFHNEEKLREALKFSNACGAICTTKKGAIPALPTVATAQDLIAKAN

SEQ ID NO: 16422 - protein, 307 aa, Streptomyces coelicolor A3(2)
MSTPTTFRPVLERIAEEIERTPGSGRPADYIPALAARDPRRFGMAVAELDGTVYGVGDWREPFSAQSLTKVFTLALDLAREGDALWEHVGREPSGNPFNSLVQLEYENGIPRNPFINAGALVVTDRLHTRTGDAAGELLAFLRAESGNPDLGHDEEVAASEAAHGDRNAALAHFMASYGNIDNPVPVLLDQYFRQCSVAASCADLALATGFLARHGIRADGTRLLSRSRAKQINAVMLTCGTYDAAGDFAHRVGLPGKSGVGGGIIAVVPGHCTLCVWGPGLDERGNSVAGVAALDRFTTLTGLSVF

SEQ ID NO: 16423 - protein, 299 aa, Arabidopsis thaliana
MSMSRLGLLLFVAILLVLLQSSTCLISSPSSIINPSKVKQVSSKPRAFVYEGFLTDLECDHLISLAKENLQRSAVADNDNGESQVSDVRTSSGTFISKGKDPIVSGIEDKLSTWTFLPKENGEDLQVLRYEHGQKYDAHFDYFHDKVNIARGGHRIATVLLYLSNVTKGGETVFPDAQEFSRRSLSENKDDLSDCAKKGIAVKPKKGNALLFFNLQQDAIPDPFSLHGGCPVIEGEKWSATKWIHVDSFDKILTHDGNCTDVNESCERWAVLGECGKNPEYMVGTPEIPGNCRRSCKAC

SEQ ID NO: 16424 - protein, 378 aa, Leuconostoc mesenteroides subsp. mesenteroides ATCC 8293
MADITATNKQVLDFNHQLTAQADSFPTLSVLDNTGKIVDDEAFERAELSNEDLINIIKRMILSRQLDIRSTKLAKQGRFGFFAPTAGQEASQMASSYAFNDDDWLMPGYRDIPQIVVKGWPIWKAILWSRGHVLGNVYTTEDDKPVNSWMPQIIIGAQYVEAAGIALGLKKRGKNAVVYAYTGDGGTSQGDFYEGINFAGAYNANAVFFVQNNGYAISTPRALQTAAPHLAAKGWAAGLPSLVVDGNDPIAVYLASKEARAWAANGNGPVLIETITNRLEAHSTAGDDPLRYRTKDDIGEWWKKEPLIRMRKLLQGQGIWNEEQEDDYVKEVNQLIDDQIKIADSVEKQKISNFIKNTLEVPSQAMKEQIAKFESEGK

SEQ ID NO: 16425 - protein, 374 aa, Zea mays
  unsure (1)..(374): unsure at all Xaa locations
MASEVEDEAATPLARXGAADVRRRRDQAKAILSTQAVRIATKAEQHERFIFKVTHLLGVLGFGGFCYLLGARPQDVPYVYCLFYVIFVPLRWIYYRYKKWHYYLLDFCYYANTFLLVMILFYPEDEKLFMVCFSFAEGPLAWALIVWRCSLVFSSFDKLVSVLIHLLPGIVLFTIRXGWNPQTFAAMHPEGRDARVTWPYVXDKSYLWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQVVQKQLKKLDMKPMEQGSSTQGAPGGDGGTLGNHHQHTSEEHIQE

SEQ ID NO: 16426 - protein, 151 aa, Zea mays
  unsure (1)..(151): unsure at all Xaa locations
MDPYKHRPSSGSNSSFWTTNSGAPVWNNNSALTVGQRGPILLEDHHLIENLAHFDRYNIPERAVHARGASAKGFFEVTHDVSHLTCADFLRAPGVQTPVIVRFSTVVHERGSPETLRDPRGFAVKFYTKEGNFDLVGNNMPGFXIRDGMKF

SEQ ID NO: 16427 - protein, 196 aa, Syrrhopodon mahensis
GGAKKVVISAPSKDAPMFVMGVNEEKYTNEDIVSNASCTTNCLAPLAKVINDKFSILEGLMTTVHATTATQKTVDGPSNKDWRGGRSAGTNIIPSATGAAKAVGKVLPELNGKLTGMAFRVPTTDVSVVDLTVRLKNPASYDAIKAALKEASEGKMKGILGYTHDDVVSSDFITDSRSSIFDAKAGIALSDTFVKL

SEQ ID NO: 16428 - protein, 462 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTHQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGI

SEQ ID NO: 16429 - protein, 110 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYMCFAALLMAGLDG

SEQ ID NO: 16430 - protein, 515 aa, Oryza sativa
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLCTFDIIIQAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 16431 - protein, 310 aa, Oryza sativa (japonica cultivar-group); identical to SEQ ID NO: 16114

SEQ ID NO: 16432 - protein, 342 aa, Bacillus cereus ATCC 14579
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAVKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVEELAKQENVQHI

SEQ ID NO: 16433 - protein, 444 aa, Porphyra birdiae
RITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDLGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 16434 - protein, 389 aa, Trichodesmium erythraeum IMS101
MAKNLLEQLRKVTIVVADTGDIQAIEKFQPRDATTNPSLITAAAQMPQYQEIVDETLKTARQELGTDATASDVANLAFKRLAVAFGLKILQIVPGRVSTEVDARLSYDTEATIAQGRDLIAQYEEAGVSRDRILIKIASTWEGIKAAEVLEKEGIHCNLTLLFGLHQAIACAEAGATLISPFVGRILDWYKKETGRDSYPPAEDPGVLSVTKVYNYYKKFGYKTEVMGASFRNTGEITELAGCDLLTISPGLLGELESTIGELPTKLSDEKAAQSDAEKILMDKETFDQMHAEDRMASQKLDEGIKGFSKALESLEKLLAERLTRLEGVTHAAEDIFYIYDLDGDGFITREEWAGSDAVFDALDINKDGKISPAEMASGLGAVFELAKV

SEQ ID NO: 16435 - protein, 329 aa, Thermosynechococcus elongatus BP-1
MAIDFKGGLMAIALLFDVTNGFHDAANAIATVVATRALSLRSALLLAAVANFGGAFLSTRVALTIEAGILHSSALGGHWFGVISAALLGAMAWNLLTWYWGLPSSSSHALIGGLVGAALFQVSPQIIYWHGIVGSVVIPMVVSPLVAIAVGLSFMTLVEKWLQWRDIPPEHWQRLQILSGMLMAVAHGANDAQKTMGVMTLALVSWGKLSPDAGVPFWVMAACALAIAIGTYGGGERIIHTTGEKITSLDPVSGCLANLSAALTVAAASLVGFPVSTTQVVVGAITGAGYRQQGEVNWHVWGQIFMAWVLTLPGAALLAMAISFCLGQL

SEQ ID NO: 16436 - protein, 304 aa, Zea mays
  unsure (1)..(304): unsure at all Xaa locations
MRNPPGRHLLCLSSRXAVRSSSSSSALGPGPGAVTSAASPRPRAIAPGRPLRASSPSPPYAVAAAAYVEDGDWEEVVAGGPGTGEMEEEQDYRVVFWSPPTIDEVTGAVTSIQQVFENPLGLDSDTTDRQTTLLSASGHSSGNSSGSDDWIEPAAYVLNSTALLSREHRNVVDAFRLLQKDPTVQKMVMSLSCDKAVWNAVMNNEAVQDFRRSLHDGKENDRNENTGGPAEVLKWILESAQAKIVEFLENVQKIINMLIHTPEDDDNPDGYSDAVKVSFMLTVFVFIVVAIARINYEHWDYKVW

SEQ ID NO: 16437 - protein, 502 aa, Rhizobium sp. NGR234
MDESVRNYLDQYGVSDATRRFLAKPQKMFIDGAWSDSSNGATFDIFEPSTGGLITRAPSGTPEDLDRAVRAARRQFDGGAWRRLKPLERERLLHSLADLIEAHSDELAEIEAIDMGKSVTFAREIDIRGTVDTFRYFAGWASKLHGRTVEPSLPGNYLAYTRKEPLGVVAAIVPWNFPLQTLAWKLAAALAVGCTAIVKPAELTSLSTLRFAELVQEAGIPDGVVNIVTGKGSIIGAAMSTHPGINKVTFTGSTPVGQEVGRTAVGNLKHVTLELGGKSPVLVLDDADLQSAAVAVANGVFFNSGQVCDAGTRVYVQGSVHDAFLDELVSVTSALKIAPGLDRDCYIGPLVSAQQKKVVSGYIEAGRREGAELIHGGASLHRQGHFIEPAIFSHCKPQMSIVREEIFGPVLVTSPFDDLDDAVSLANDTPFGLAAAIYSNDLSRVHTLIPRLHAGSIYVNAHSTIDPAMPFGGFKASGFGKDLGPEQLDYLMETKAVWITLP

SEQ ID NO: 16438 - protein, 469 aa, Photobacterium profundum
MSVENVLALIQENEVKFIDLRFTDTKGKEQHITIPSHQIDSDFFEDGKMFDGSSVAGWKGINESDMVMMPDASSAVLDPFTEDSTLNIRCDILEPATMQGYDRDPRSIAKRAEEFMRSTGLADTVLVGPEPEFFLFDDVKFNTDMSGSFFKIDDIEAAWNSGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHMSLNKDGQNLFAGDKYGGLSEMAIYYIGGIIKHARAINAFANPATNSYKRLIPGYEAPVMLAYSARNRSASIRIPVVPSPKARRIEVRFGDPAANPYLAFAAMLMAGLDGIQNKIHPGEAMDKDLYDLPAEEAAEIPQVAESLEIALKNLDEDREFLTAGGVFSDDFIDSYIKLKSEDVEKVNMTTHPLEFELYYSV

SEQ ID NO: 16439 - protein, 562 aa, Shewanella oneidensis MR-1
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKERYCCFNDDIQGTAAVTVGSLLAACKAAGTELNKQRVAFLGAGSAGCGIAEAIVAQMVSEGISDEQARSQVCMVDRWGLLLDNMPNLLPFQQKLAQKCADISHWNNFSDNISLLDVVNNAKPTVLIGVSGAPGLFTEEIVRAMHSHCPRPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 16440 - protein, 515 aa, Candida albicans
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGVTEISFETLKQCEYLKAVINETLRLYPSVPRNGRFANKNTTLPRGGGPDGMSTILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 16441 - protein, 831 aa, Oryza sativa
  unsure (1)..(831): unsure at all Xaa locations
MPVADCESGLSPADVTGAGAANGNPGHWRSYYRHVLLLAYQSCGVVYGDLSTSPLYVYKSTFIIGSLRRFQDEEIVFGVFSLVFWTLTLIPLLKYVFIVLAADDNGEGGTFALYSLHGKTPILTALRRFLENHRKSRTFLLVTVLFGASLVIGDGVLTPPMSGERAYRNTTTTWCVVWVADVIDDRSFVLAAGWAVLSSFSGLQVHSTALTSGEVEILSCTVLVCLFMVQHWGTHRVAFLFAPVVIVWLLLLGALGVYNIVVWNPRVLRALSPYYLVRFFQHTGKDGWISLGGILLSMTGKQTLFCSLHCDSSTTYFIIIYIWTEAMYADLGHFTAASIRVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVRPCQDGAPHAGARRGGERXVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 16442 - protein, 170 aa, Zea mays
  unsure (1)..(170): unsure at all Xaa locations
MAPTVMMASSATAVAPFQGLKSAAXLPVARRSTRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 16443 - protein, 599 aa, Ferroplasma acidarmanus
MNNTIANICLAVTGKILYYVFPYFQMRDTDSLHSGSISNDKKLKKVLTSWDLYFLSLGAIIGSGWLFAESAAAGTAGPAAILSWIIGGAIVLVLVLVYAEIGAMIPRSGFITRYGHYSHGGIAGLFFGWGYFAARVAAPALEAEAAITYAGSYITKPALIYYAKNPLDPSSSVTLLSGYGILIAAALIAGFYFLNYFGVKLMGKTNQGITWWKLIIPSITIILMVFLLFHAGNFNNPALGGFLPHNNISLVFEAISTDGIVFSYLGFRHTLNFAGEAKNPQRDIPRALIYAMLTSIVVYVLLQFAFISAINPSLLTASGGWLGLSSASAGTYAKSIDSAPFAFLAKSSSLAILAVLTYLLYADAYISPAGTLNIAAGTATRSLYGLAEIGYFPRTFGKVSKRTGVPVFSLLISLVLGLIFLVPLPSWYVVVGLVSGVAGFTYILGGSTLMVLRREASDLKRPFKLPYARILSPVAFIGASLIVYWTGWPTVAYIAIILFAGFAVYLVFLAFHHVDNIFTKENIQGGYWVPLLIIALTILSYLGESNFGGINLFPFPYDFLVVMVVSLIFYFLSVKSGFRTSEITDMIESGEQYIDEYAE

SEQ ID NO: 16444 - protein, 352 aa, Synechocystis sp. PCC 6803
MAGCPAFSLLDFSASINPLGPPASVLAAIESALPALRHYPDPQYIHLRQAIADHHQLSMDWVLPGNGSAELLTLAGRTFASLDCTYVVGPAFGDYGRSWRGAGAELKTIPWQVDQPWPWRKLRSPSEIANTSAVQSSHHGLILNNPHNPSGTLLAREEILALLPHYQWVLLDEAFMDFLPPGEEQSLVGDLEKHPNLIILRSLTKFYRLPGLRLGYALAHPDLLAQWQAWRDPWPVNVLAEAAAIASLEAEEFRQLVWQWLPPARSALQQDLASLPGLFPLPSQTNFLLVKTTIPAPELQEELLTKCQILIRDCLSFPELGEDFFRVAVRTMADNQKLTQALATIMATAAPS

SEQ ID NO: 16445 - protein, 287 aa, Arabidopsis thaliana
MAKLRHSRFQARKWSTLMLVLFMLFMLTIVLLMLLAFGVFSLPINNDESSPIDLSYFRRAATERSEGLGKRGDQWTEVLSWEPRAFVYHNFLSKEECEYLISLAKPHMVKSTVVDSETGKSKDSRVRTSSGTFLRRGRDKIIKTIEKRIADYTFIPADHGEGLQVLHYEAGQKYEPHYDYFVDEFNTKNGGQRMATMLMYLSDVEEGGETVFPAANMNFSSVPWYNELSECGKKGLSVKPRMGDALLFWSMRPDATLDPTSLHGGCPVIRGNKWSSTKWMHVGEYKI

SEQ ID NO: 16446 - protein, 476 aa, Rhizosolenia setigera
  unsure (1)..(476): unsure at all Xaa locations
RYESGVIPYAKMGYWDASYTVQSTDVLALFRITPQPGVDPVEAAAAVAGESSTATWTVVWTDLLTACERYRAKAYRVDPVPNSTDSYFAFIAYECDLFEEGSLANLTASIIGNVFGFKAVSALRLEDMRIPHSYLKTFQGPATGIVVERERLNKYGTPLLGATVKPKLGXXGKNYGRVVYEGLKGGLDFLKDDENINSQPFMRWRERFLYCMEGINRAAAATGEVKGSYLNITAATYEEVEKRADYAKAVGSVVVMIDLVMGYTAIQSIAHWARDNDMVLHLHRAGNSTYARQKNHGINFRVICKWMRMSGVDHIHAGTVVGKLEGDPLMIKGFYDVLRLPVLDVNLPFGIFFEMDWASLRKCMPVASGGIHCGQMHQLIHYLGDDVVLQFGGGTIGHPDGIQAGATXNRVALEAMVMARNEGADYFNNQVGPQILRDAAKTCGPLQTALDLWKDISFNYTSTDTADFAETPTANI

SEQ ID NO: 16447 - protein, 498 aa, Shewanella oneidensis MR-1
MSTPKTRSDWENLAVSLAINGKAFINGEYRDASSGNTFDCISPIDGRLLAPVASCDLMDANIAVANAREVFDSGVWSKAAPVKRKQVMIRFAELLEENANELALLETLDMGKPIRFSKAVDVAGAARAIRWSGEAIDKLYDELAPTAHNEIGMITREPVGVVAAIVPWNFPLLMACWKLGPALVTGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIGFNQGEVCTAGSRLLVESGVKDELVGLIAEELASWQPGHPLEPTTVSGAVVDKQQLDTILSYIKAGQNEGASLVYGGQQVLAETGGVYVQPTVFSNVKNQMKIASEEIFGPVLSVIEFNGMEEAIAIANDTIYGLAAGVWTADISKAHKTAKALRSGMVWINHYDGGDMTAPFGGYKQSGNGRDKSLHSFDKYTEIKATWIVL

SEQ ID NO: 16448 - protein, 219 aa, Eremothecium gossypii
MSNNEDYGYDYDYLFKIVLIGDSGVGKSNLLSRFTTDEFNVNSKSTIGVEFATRTIEVEGKKVKAQIWDTAGQERYRAITSAYYRGAVGALIVYDISKSSSYENCNHWLTELRENADENVAVGLIGNKSDLAHLRAVPTDEAKNFAQGNQMLFTETSALNAENVDLAFRELITAIYQMVSKNQVDLSENNGSGTVPRGPTISLAPAPSEKSKKKTNNCC

SEQ ID NO: 16449 - protein, 193 aa, Zea mays
  unsure (1)..(193): unsure at all Xaa locations
MARMACRVALFATVLLCAAAGAAXGTKRAPIPDDLRDVIDEEEDDEWRQYRVPSSRGPGRGDGPPPXLSRMDPAALQAELLRGQTGPSFGFVKLRPGTTRSREHVVGIARRWSNVLRTGSVDARFTAVNFVTLMFTMERGRDILELKEFVLSQAEAYELRIGDQVFRRPGDPPLDQVLRKPRKKKRRKSRDEL

SEQ ID NO: 16450 - protein, 320 aa, Oceanobacillus iheyensis HTE831
MKRMDVIGIGETMVSLTPDKYGLIRQTSSFEPRVAGTETNTLIGLSRLGHNTGFISRLGEDELGAMVLKELRGENVDTKLIDLDPYHQTGLFLKEIINESDVHVYYYRQHSAASQMTRELLDESYISSASYLFITGITPAISESCKQTIFTAINMAKNNGVKIVFDPNIRKKLWSESEARQTLIEILKLSDIILPGISEGQFLLDSNDPEEIGKKCVDLGAELVVVKLGENGAYYCTSDHGDYVPSFPVKQVRDPVGAGDAFAAGLLSGLIDELSIEKAVERACITGGYATTYVGDYEGFPDKSRLERLTNLSTSEDVSR

SEQ ID NO: 16451 - protein, 290 aa, Oceanobacillus iheyensis HTE831
MVNITVVGSSSIDLVVTAPTRPKAGETIIGDDFQTVPGGKGANQAVAASRLGANVSMIGRVGKDTFGEEILSNLQENKVSVEYVEPVTDVASGTAHITLAEDDNSIIFVKGANDYVTPDYIKKSLDKLINADIVLIQQEIPEETVEFVIETCHTYEVPILLNPAPAREVSNQVIERTTYLTPNEHEFSIMFGNENRSDVLKRYPNKLLITEGKNGVRYFDGEAEIVIPSYEVVPVDTTGAGDTFNASFAIAIAEGRSLEDAIRFANKAASISITKFGAQGGMPTRTEMEE

SEQ ID NO: 16452 - protein, 520 aa, Oryza sativa (japonica cultivar-group)
MSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAEW

SEQ ID NO: 16453 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNLPTPDEPGHTLGGYSQQIVVHERYVLRIRYPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 16454 - protein, 74 aa, Glycine max
MISMILSKMQVKNVIEKPHNDHLPLIEASRLCNMDIISHVQQVICFAFHDSRLLMETCQEAKNLRKIVTLFYLD

SEQ ID NO: 16455 - protein, 363 aa, Zea mays
  unsure (1)..(363): unsure at all Xaa locations
LSQTAQSPRLFKPTGGHILAARAAAGNAPTSPVREGVTELDAVAGFSEIVPDTVVFDDFERFAPTAATVSSSLLLGITGLPDTKFKSAIDTALADGGXTHLEKAEDRDVLVTSPGLLQMVGAXLGQQGPWGKVPPEKKARLAYDTQGIIHRVHELLNLYNQHDVSTDRLLFKIPATWQGIEASRLLESEGIQTHLTFVYSFAQAAAAAQAGASVVQMFVGRLRDWARHHSGDPEIDEALKNGEDAGLSLAKKVYAYIHRNGYKTKLMAAAIRNKQDVFSLLGIDYIIAPIXDVKYGYVPKLTPAIGKTYNFTEEELVKWDQLSLSAAMGPAAEELLASGLEGYVNQARRVEELFGKIWPPPNV

SEQ ID NO: 16456 - protein, 690 aa, GIBBERELLA ZEAE PH-1
MLRSRPTRQAIRAFGHARARTTLPATQRTKATATTSAAPQTRPVPSPAFNLEPESRRHVQPLVNRSNPEMDESFIGKSGGEIFHEMMLRHDVKHIFGYPGGAILPVFDAIYNSKHFDFILPRHEQGAGHMAQGYARATGKPGVVLVTSGPGATNVITPMQDALSDGTPIVVFTGQVVTSAIGSDAFQECDTVGISRSACKWNCMVTSIAELPRRINEAFEIATSGRPGPVLIDLPKDITAGILRKAIPTQTRLPSIPSMASQTAKQVMEKQLNASLSRAADLIKIAKQPIIYAGQGIIQSEGGTELLRELADKCSIPVTTTLQGLGAFDERDEKSLQMLGMHGMAYANMSMQEADLIIALGARFDDRVVLNTSKFAPNAKAAAAEKRGGIIHFDILPKNINKVIQATEAIEGDVATNLKMLMPMLTPTSMEQRSGWFNKISEWKAKWPLSNYEHSDAPGGSGLIKPQTLIEELSDLTSKIDKKTIISTGVGQHQMWVAQHYLWREPRSFVTSGGLGTMGFGLPSAIGIAVAKPDALVIDIDGDASFNMTLTELSTAAQFNIGVKVIILNNEEQGMVTQWQNLFYEDRYAHTHQKNPDFIKLADAMGVQARKVTKPDDVRASLEWLINTDGPALLEVVTDKKVPLLPMVPAGAGLHEFLVYDKAFDYREGQGSTSANARANQWSSRFLIKK

SEQ ID NO: 16457 - protein, 470 aa, Gracilaria beckeri
GVIPYAKMGYWDPDYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQPGATANRVALEAMVIARNEGRDYVAEGPQILRDAAKTCGPLQTALDLWKDITFNYTSTDTADFVETPTANV

SEQ ID NO: 16458 - protein, 182 aa, Streptomyces coelicolor
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 16459 - protein, 398 aa, Zea mays
RFAVAVQIQSQATMICVDNSEWMRNGDYPPSRFAAQAHAFAVLSGAKTEANLESTVGLVAMAGKGVSVLVPPTNDFGKVLSGMNGLEIGGEANLTAAIQVAQFALKNRQNKQLRQRIIVFVGSPVIDEKNWLEVIGKNLKKNNVALDVVNFGESDNEKPEKLEALVAAVNSGGNSHIIHIPAGRDLSDALFSSPIILSEDRGSDSAAAARGASGFEFDVDPNVDPELALVLLISMEEERLRQEAAAKKAREESSKTENEGQSSTSNGDIVMADAEPEPNSYTEDKGLHCKDEGQLLEQARKIRIEDYISFEELFDGVTSDTMSAFQEEETCTQSDAGKDFGHQPFEPSLSDVELLNDLSNKVALEWEELFIDPSKCMAEGPQGFYFASLDEKGYLFSC

SEQ ID NO: 16460 - protein, 304 aa, Lycopersicon esculentum
MAKLKIVNIVFFVLLGIGICSAARTLLTYDHVGVGGEVGAYAGGGGGGSGGGGAYAAGGHDGGYAGGGGSGSGAGGGHAGGGYAGGGGGGSGAGGTHAGGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 16461 - protein, 133 aa, Mycoplasma pneumoniae
MAQFIQEVKADGIVCPEARGFIFGGALASKTKLPLVLVRKPHKLSGELARETYDLEYRQNSILEMRVDALENCKRCVIVDDLLATAGTVAAIDKLIARLGSQTVGYCFLIELQKLHGKAKLQPNVATKILLHY

SEQ ID NO: 16462 - protein, 170 aa, Helicobacter pylori
GSGMHTHVSIWKNNENLFSGEAYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 16463 - protein, 468 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEM

SEQ ID NO: 16464 - protein, 708 aa, GIBBERELLA ZEAE PH-1
MSSRQLRKLQKQRELEEVQKIAEKDSEESEDDQLPIAPKPRVSLFAALGGDDEEEAQDEEEEEQQTEEDVSETKKPVATGKNKKNKKKKKKKAAKAQAPPPEEDEDEIDKAIKELNITASKSADPSTAGDSTVQTRRINELLSINPYHLKVANEMKNLFGSDIIQSAEAEEEQERNRRFRGNAPREVDIETFLRGPPGQPKLPEISLRRNAFIQGREHWPKQSAGGLTMKETKKADDGSWTEYAYFHDKNYDATQAFFFSCVQIGDPMRMVHVLKEFPYHVSTLLQVSSVAKQDQNMALAAELCERALFTFGRVTTNAFRQNIEHGKARLDFCRPENRQLWLAGYHYLKSLIRKGTYRTALEWAKLLYSLDHKDPYGMRHFIHFLALRARESRWLVDFVTELEKTSDNRDTIYLRQSLVLAHLQLGDTARATEELEKGMRRVPWLYCGLFQELNLDTPPSIWGISADSDSRSFWVKLYIHQAKDLWNNAQATSLLTTVAKNLEKVDTSVLPADDSPPDHGVTRLIFLEGQTSLIALAPREYLDVQPNYEFDPLPPPEEENIFSGHGTRLPWEDRQRGGAHRPMHEIEERLRNIFARRAAAAAPANGAGGGEEVDSDDEAALLAQLDDEELERDLAAARNGSDGGVLGVLMQLLGVQTGPTTDSERPDEADADRDGQDQDRETGVGGGAGSGSGSGTDGGIPGAWPEDH

SEQ ID NO: 16465 - protein, 165 aa, Secale cereale
MMASSATTVAPFQGLKSTAGLPVSRRSSGSLGNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 16466 - protein, 505 aa, Novosphingobium aromaticivorans
MASGQLRYYAPMTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 16467 - protein, 637 aa, Oryza sativa; identical to SEQ ID NO: 4303

SEQ ID NO: 16468 - protein, 427 aa, Triticum aestivum
  unsure (1)..(427): unsure at all Xaa locations
MLPQQSQAAAMMQQAAAMQSMYAMPPPPHHHHLLGAAPPQQIEPILTGNLPPGFDTSTCRSVYVGNIHVQVTEALLREVFQSAGSVDGCKLIRKEKSSYGFVDYYERGSAALAILTLNGKQIFGQPIRVNWAYASGQREDTTDHFHIFVGDLSPEVTDSALFAFFSAYSPNCSDARVMWDQKTGRSRGYGFVSFRNQQDAQSAINDLNGQWLGNRQIRCNWATKGANSGEDQLTSDSKSIADVNNNFTENAKQKSNEDAPENNPLYRTVYVGNLAHEVTQDVLHRFFHALGAGAIEEVRVQHGKGFGFVKYSNHAETALAIQTGNGRILGGKPVKCSWGNKPXTPPGTTFAPLPPPAAPGHPAAADLMAYQRAIAMSKMASTQALMQAQHLRQAAMGMGVGASQAMYDGTFQNVGASQQQQQQLMYY

SEQ ID NO: 16469 - protein, 406 aa, Agrobacterium tumefaciens str. C58
MEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 16470 - protein, 364 aa, Neurospora crassa
MQIKTLTALAFASLVSAQTYTDCDPTKKTCPNDKAVGKEIINIDFTKGADSFFKNMVGTTLQYDNKLGAVYTIKKETDAPTVASSRYIFFGQVDVTVRAAFGKGVVTSFVLQSDDLDEIDWEWIGSDTTQVQTNYFSKGCTETYDRGGFSTVANPQNEFHTYTIKWTPTQLDWIIDGAVVRTLKAADAKGCAGFPQTPMQIKLGTWVAGRKDAAQGTIEWAGGITDFNEGPFMGYYQSIKIQDFMGGDGTTGAKDATEYQYGDKSGTWQSIKVLTGTSTTEDVGTKSGSSTATTLSAVPSASSTSGSSSLPIDSTLNNNNNGSSSTSDATEATKSGNVVTGGAGKLAMSIASLGAALFAGAMLL

SEQ ID NO: 16471 - protein, 282 aa, Escherichia coli
ALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLDKNGVEERKSIGTLSAFEQNALEGMLDT

SEQ ID NO: 16472 - protein, 518 aa, Phytophthora infestans
MMLGDNSPLTRLAVAATAAVAFSAFVVSAQESTVTCEVSQYLDSATNECVDYSSRGAKAGNAYDTTIDSGNTAWMLMSSALVMLMTPGVAFFYAGLAGEDMASNTMMMSFVSMAMVSIQFFAFGYSACFSSDGIFAWAGYNNVGAVASGTYGGSIPHILFAFFQTQFATITPALISGGIVGRMKFGSYLLFILLWTSIVYDPLARWMWSLKLDEIWEITAMGWEGKMGALDFAGGTVIHVSSGFGALVAAIVVGKRYNHGEPVKPHNVPLVMIGATLLWFGWFGFNAGSQGAADGVAAIAAINTHLAPCAGFLTWSALEFAFHKNFDPCGAISGAVAGLVAITPGCAFVYPWAAVIFGVVGSATGFGAVHLKNVLRYDDTLDSFGIHGCGGFMGGLLTGLFATSEINPSIEGGAFYGHGMQFVHQLVSQCVAAAYSAVVTFLILMALKYTVGLRVSEEKEVNGMDISYHGGQAYDYSAHGGLSSPTVKAANPPVGDFMSMMTSGQPSGNGANHIANEL

SEQ ID NO: 16473 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVGYEGLTGGLDFLKGDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAPTCGPLKAALDLWKDITFDYTSTDTPDFVEVATESR

SEQ ID NO: 16474 - protein, 212 aa, Prochlorococcus marinus subsp. pastoris str. CCMP1378
MSELQRLKSLLPPENESWVFIEAAAAIDPPLIALEEIGRDEVEIQIDLEEWDNYAIDHRNLLFWHEVGKIQNDAIPRDGWEMAALAIGLGGAIGELWVQDGLLLILALGLSGFAGYRLYIKNNSEKRLQDAIFADERAIDLACRFGYSIPNAYKSLGGALKELIEKTRKKKKRIIFEDRLEALRKSAEKARSELSQQEGSDKSVSSENVYGQ

SEQ ID NO: 16475 - protein, 594 aa, Novosphingobium aromaticivorans
MAGNLEPTTALSDALVILGAAGIIIPAFARFRITPIIGFILVGLVVGPFGLGSLVPQYPWLYHVTISDPAAITPFAEFGIILLLFEIGLELSFNRLWDMRRLVFGLGAMELGVSAFLLSAVLLGTGLNISGAFGLGLALALSSTALVLPIAGTHGPVGRAALSMLLFEDIALVPIIFILGAMGPVAAHSDGPSLGETLLYGGIVVAVLLVGGRLLLPRLFAQAAQTKSPELFLAATMLVVIAAALSTSLVGLSPIMGALLAGLLIAETEYHTEVESITKPFKGLALGVFLITIGMGIDLRVVWEQIGPLALAVTGVVVLKALVTMFALRAMGKERATALEAGILMASPSETTLIVLATAAEASLIDRETAQFWQIVTAIGLTITPLLAKVGETWGRRVAKGGADAGQAVAVEEPEGERVVVMGFGRVGRLVADMLSVHGASWLGIDTDPAIVKRARNDGLPVLFGNVDSETAIERLGLDNARAMILTMDEPVLVVRMVKKLRSGHPDLPIIVRARDTAHAAELYKAGATHAVPETLESSLQLSEAVLVDLGFPMGLVIASIHEKRDEFREQIMEEGGLTEKPRLKSASLRERSA

SEQ ID NO: 16476 - protein, 513 aa, Nitrobacter sp. PJN1
MDIRSQVSMVFHLDKCIGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLISAPLADEQPTARAISMVTGKYMDTIEAGPNWDDDLGGSQVYANNDPNFDGASDEEMRQINEINSTAFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPDSKIEAAQKSPVYQFVKKWGIALPLHPEFRTLPMLFYVPPLGPVLAKVENGVYDNIASGSRLGPLMSSLERSRIPLRYMASLLAGGNEDIIRGVYKKLVAVRVYMRSRKVKDIPDEEVQRALAEGKTTAAEVEAIWRLTSMPTFEERFVVPPMERETAVDALFPQLDPVSHNYPIRKGAVGVGFHTDPARGP

SEQ ID NO: 16477 - protein, 223 aa, Listeria monocytogenes EGD-e
MSKKLICPSMMCADFSGLEREVEELDKAGSDVFHVDIMDGAFVPSFGMGLQDFEEIRQKTQKLVDVHLMIMNPGDYVEMFADKGADIIYIHPEADLHPARTLDKIRNKGKKVGIAINPGTAIATIKELLPLVDNVMVMTVNPGFAGQKYLDYVDVKIAELVELKKDYTFEIMVDGAISPEKISKLSQLGVKGFVLGTSALFGKKESYAEIIKKLKQEKMEELR

SEQ ID NO: 16478 - protein, 569 aa, Arabidopsis thaliana
MDSARSWFHKFQPRDKPRKKDMFSGSTYGGGVTETTVPDGGNDTETATKLPPLGGDGEALSNSTKQKVAAAKQYIENHYKEQMKNLNERKERRTTLEKKLADADVCEEDQTNLMKFLEKKETEYMRLQRHKMGADDFELLTMIGKGAFGEVRVVREINTGHVFAMKKLKKSEMLRRGQVEHVRAERNLLAEVDSNCIVKLYCSFQDNEYLYLIMEYLPGGDMMTLLMRKDTLSEDEAKFYIAESVLAIESIHNRNYIHRDIKPDNLLLDRYGHLRLSDFGLCKPLDCSVIDGEDFTVGNAGSGGGSESVSTTPKRSQQEQLEHWQKNRRMLAYSTVGTPDYIAPEVLLKKGYGMECDWWSLGAIMYEMLVGYPPFYADDPMSTCRKIVNWKTHLKFPEESRLSRGARDLIGKLLCSVNQRLGSTGASQIKAHPWFEGVQWEKIYQMEAAFIPEVNDDLDTQNFEKFDEEDNQTQAPSRTGPWRKMLSSKDINFVGYTYKNFEIVNDYQVPGIAELKKKESKSKRPSVKSLFGTESDSSSSGSEQQTINRSYSNPTPRGMEPNLRRLDSE

SEQ ID NO: 16479 - protein, 286 aa, Triticum aestivum
MDTPHTRTNTAVQMASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 16480 - protein, 475 aa, Thermoanaerobacter tengcongensis
MANSTSSYLWRKKTLEMVLSETEAEQFKLKKTLTAIDLIALGIGAIIGTGIFVITGVAAAEKAGPAIVLSFILAGLACAFAAISYAELASMFPIAGSTYNYAYIAMGEFLAWIIGWDLILEYVFALPAISLGWSGYFTNLLGSIGINIPAWAANSAWQAPGTGGLINLPAIGILLAIAILNYIGVRETATVNNIGVAFKVFVVLFFIFTAVWYVKPANWSPFLPYGWAGVFHGAAIIFFAYIGFDAVSTAAEETKNPAKDMPIGILGSLGISTLLYIAVSAILTGVVSYTELNDPAPVAKALNLIGLNWARGLVSLGAIVGITTVLLVMFYGSTRIIFAMSRDGLLPPIFSKVHPKYRTPTLAIYLITIATTLVAGFFPIGVIAELVNIGTMLAFVLTSIATIVLRYTQPDLPRKFRAPGMPWTGILAIAFVLSLMVSLPWETWVRLIVWFVIGLFIYFGYGRHNSILAKQQTQH

SEQ ID NO: 16481 - protein, 306 aa, Vibrio vulnificus CMCP6
MKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 16482 - protein, 415 aa, Schizosaccharomyces pombe
MDVSTQTRHATYFQDENQLQKDHIYVKKKSHIKLNTGVPAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRAHSYDHDIRMLAKYLQEVTLMDEIFIGAHISFIAATAYYLSMQMLGHLDWTPCHVYYSGYTARQLKPCANIIWECLVDAPNHHNAIYRKYSENRMKRVSAFAHNWVLSVI

SEQ ID NO: 16483 - protein, 181 aa, Brucella melitensis biovar Suis
MESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 16484 - protein, 369 aa, Oryza sativa
MVMMVDPPNGMGNQGKHYYTMWQTLFEIDTKVVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPVQVPIDLDIDENLGVDMIREMMWQEMLHYHPEVVAGVNM

SEQ ID NO: 16485 - protein, 221 aa, Arabidopsis thaliana
MNYSNNYIEHQNKKKTIIIFFRQFKKQKPMLRMGVHLVGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLNREAHRKYNTSKFFHAARSEPAGFLL

SEQ ID NO: 16486 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 16487 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATCCFVRCLVSSLLCCHVLLCAIFRTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 16488 - protein, 497 aa, Pseudomonas putida KT2440
MYTLEFWQQRASDLYLPAHALIDGKPVNAQDGATFAAINPATNNVLAQVAACGHAEVDLAVASARRAFEQGPWPRMAPGERKKVLLRLAELIMAHREELALLDSLNMGKPVMDAYNIDVPGSAHVFAWYGEALDKLYDQVAPTAANALATITREALGVVAAVVPWNFPLDMAAWKLAPALAAGNSVVLKPAEQSPFSALRLAQLALEAGVPEGVLNVVPGLGEQAGQALGLHPDVDCLVFTGSTQVGKYFMQYSAQSNLKQVWLECGGKSPNLVFDNCQDLDLAAEKAAFGIFFNQGEVCSANSRLYVQRAIHDEFIERLQAKARQWLPGNPLDPASRAGAIVDAGQTGRIEAAIVRAGQEGARLVCGGRRLTIEGSDNYIEPTIFAGVEGRMSLAREEVFGPVLAVSAFDTEEEAVRLANDSIYGLVASVWSDDFNQVHRVARALKAGTVSVNTVDALDVTVPFGGGKQSGFGRDLSLHSFDKYSQLKTTWYQLRG

SEQ ID NO: 16489 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQQKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 16490 - protein, 409 aa, GIBBERELLA ZEAE PH-1
MSADEKIRVSGETPRSTSPVLPTVNPGLENNFYPRIDFCDATFANGARSAWIGFSSSVILFNKWLLDTLNFRYPVILTTYHLTFSTIITQVMARWTPYLDGRKTVKMTARVYIRAVVPIGIFFSLSLICGNLTYLYLSVAFIQMLKATTPVAVLISGWILGVSAPNLKQFLNVSAIVVGVIIASMGEIHFVTVGVLFQMGGIIFEALRLTMVQRLLSSADYKMDPLVSLYYFAPICAVMNGVVALIWEVPNCTMAEVYHVGLFTFFLNGLCAFMLNVSVVFLIGKTSAVVLTLCGVLKDILLVGASMMIWGTQVSPLQFFGYSIALGGMVYYKLGYEQLKGHIADANRQWADFGARKPVLRKVTVLVATAFLIFTLFGGFAPSYSSEVDPATLANEVSNRFGINDAQHV

SEQ ID NO: 16491 - protein, 356 aa, Streptomyces glaucescens
MKALVLAGGAGPRLRPITHTSAKQLVPVANKPVLFYGLEAIAAAGITDVGIVVGDTVAEITEAVGDGSKFGLDVTYIPQRKPLGLGHGVRISRDYLGDDDFAMYLGDNFVVGGIDQPIRAFRTHRPDAHLLLTRVSDPRSFGVAELDERGRVRHLEEKPTHPGSDLALVGVYLFSPAIHEAVRAIEPSWRGELEITHAVQWLIDEGKDVRSTLISGYWKDTGNVTDMLEVNRLVLETVEPRCDGDVDEDSELIGRVRVDEGAVIRNSRVIGPVVVGSGTTITDSYVGPFTSIAEGCLVEDQPSWSSPFVLRNASISGVRRIEASLIGRHVRVTAAPPVPHAHRLVLGDHSTAQISS

SEQ ID NO: 16492 - protein, 341 aa, Oryza sativa
MRPSLMRSASQVLRRRRGYSSASGQPERKVAILGAAGGIGQPLSLLMKLNPLVSSLSLYDIAGTPGVAADVSHINAPAQVKGFMGDDQLGEALEGSDIVIIPAGVPRKPGMTRDDLFNINAGIVKNLCTAIAKYCPNALVNMISNPVNSTVPIAAEVFKKAGTYDEKKLFGVTTLDVVRAKTFYAGKANVPVTDVNVPVVGGHAGITILPLFSQATPATNALSDEDIKALTKRTQDGGTEVVEAKAGKGSATLSMAYAGAVFADACLKGLNGVPDVVECSFVQSTVTELPFFASKVRLGKNGVEEVLGLGQLSEFEKEGLENLKGELKSSIEKGIKFAHAN

SEQ ID NO: 16493 - protein, 1684 aa, alkaliphilic eubacterium 163-26
MKQQLNRVISIVLCLIVMLSVFESTIMLLPGSVEVKGQEYRELNQLENKPFSWDNANVYFVLTDRFYNGNTSNDNSYGRPQIDAWGTNIGTFHGGDIKGLTKKLEEGYFTDLGTNAIWISAPWEQMHGWVGGKDGDFAHYGYHGYYGLDFTAMDQNMGTIDEMREFVDLAHSLGIRVVLDIVMNHVGYPTIVDMHEFGFGDTGGLPRDWTPNQAQGQNWHTHNDIMNKDNEAAWANWWGSDWIRADETAGYDNCGGSEQTMCIGFLPDIKTEVTTGVDLPPILRNKWNDQASGYEDWFVPAAEPYRQDLNIAPKDYLIKWITSWVEEFGIDGFRVDTAKHVEIERWAELKNEAEVALQTWRENNPDKPGANWDDNFWMTAEVFGHGLGKSEYFDFGFDSVINFEFQNANFNNLEGLFSRYANSINTDPDFNMLSYVSSHDTKLYSRDDLIQAGTALLLLPGGVQVFYGDETARPLGDGGSDPEQGTRSSMNWANINQNVLSHWQKLGQFRNNHIAIGAGAHQKLSDSPYTFARTYESDDIVDEVVVATGAQGTTAVTVEGVFEDGTVVRDAYTGDETTVTKGTATFTAGTQGIILIENTAEPVTNLPIVSATPGNSSFRTDDITITLNVDRADMGKYTLDGSDPADGLTFMDGEEIVIGADMEFDETATLRLYAENENGIRTRSYTYRKVDPDALLEVYFKKPADWGTPHIYYYDTFPEEPEVTWTTAPEMTLVEDDWYVYVFENAESANIIFKDSSGKQIPGPNEPGFFIDQIGWYDGVKWLDSDPFEREPKEPATTPKNLSVVNVTETTVTFEWDQSDGYVVEYEILRDEDVVASTIRTTFTDEDLNPDTTYTYSVVAVGEGGQKSAPSEALKVTTLEENDEPKEPAEAPENLRIADITDTTVTINWNASNGYVTGYEVLRDGVVIGETTRTTFIDTGLDADRTYTYTIVALGDGGQKSDPSEALEVTTQEKPEGNLVTIYYKKGFDTPYMHYRPEGGEWTIVPGIRMEESEIAGYSKLTVDIREASKLEVAFNNGRGAWDSDQENNYLFEPGVHTYIPSHEGRGEIIPGKPGAPIDGNKVTIYYQNGFDTPYVHYRPEGGNWTNAPGLKMEDSEFASYSRLTLDIGEANRAEVAFNNGRGLWDSDNENNYFFNIGDNTYIPGKNGSAGEIYGGKPRPPLVGNEVIIYYKNGFDTPYVHYRPEGGTWTNAPGIKMDKSEIAGYSKITLDIGRADRVEVAFNDGRGAWDSDNERNYLFVVGNNTYEPGINGAPGQVKHGVLPDDGEDPGDIEDPDHTSPSKPTDLTAIATAHTVSLSWTASADDVEVAGYKIYRDGVEIGVTESTTYTDSGLTAETTYSYMVQAYDTSNNFSALSDELTIETAEKTGVDPGGDMPYSTNPSFGKKVTTPITIDGVNDGEWTDDMLIAIGMAGDDPRSLGDNWSMHETPMDLTHLWGAWDHEYLYLAWQYVDVTDIIDPANAGSSAGTTISQMDMPQTIAIDTIPEQGATHDMWGKNGGESLWGGPDLPDYQLNIASNMFHSGYISRAVDGVFPVDDGGINYKTGEEAGITVKFSKGKGYSTLWGVLDADDAVDPSKLVNFTELAHDSTRDTFYEAKIPLAAIGNPDIENERIGVMIHQGEFSPMDTLPNDPATSDTPGVSESNSPLEWEDIDLLTVPFARIGQ

SEQ ID NO: 16494 - protein, 364 aa, Rhodobacter sphaeroides
MKAARLYEYDPAMNVRLKIEDVPSPTIDRPDEVIVKVGAAGLCRTDLHIIEGVWRDIMDSHGSLLPYIMGHENAGWVEDVGSGVTSVKPGDAVICHPLRTCGICLNCRHGHDMHCQNNLFPGLGLDGGFAEYFKTSERSLIKLNTGITPLSVAPMADAGITAYRAAKRAAKLLNPGDWALILGVGGLGHIALQVLNEMAGCRTIAVDREPGAQVLAKELGADKVLSGGPDLIEEVRQITGGGARVVIDFVGELGVENLCWKLLKNGGDLIMVGYGGTIEIPTLELVAREIRIGGSLVGDYTELVELMELNADGKVKMHQTEFALEDINTAIDDFKNRRFTGRGVIVPGAPSARRVEERTAEAVK

SEQ ID NO: 16495 - protein, 553 aa, Oryza sativa (japonica cultivar-group)
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 16496 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 16497 - protein, 448 aa, Lactobacillus gasseri
MCTMSKTITAEDIKKSVKDNDVRFLRLAFTDINGTSKAVEVPTSQLDKVLTNDIRFDGSSIDGFVRLEESDMVLYPDFSTWAVLPWGDEKGGKIGRLVCSVHKTNGEPFEGDPRNNLKRILKEMNDMGFTDFDIGFEAEFHLFKLGEDGNWTTEVPDHASYFDMTSDDEGARCRRDIVETLESIGFEVEAAHHEVGDGQQEIDFRFDDALTTADRVQTFKMVVREVARKHGLYATFMAKPVEGQAGNGMHTNMSLFKDGKNVFYDKDGEFHLSDTALYFLNGILEHARAITAIGNPTVNSYKRLIPGFEAPVYISWASKNRSPLVRIPDAEEINTRLEMRSADPTANPYLLLAACLSAGLNGIKEAKKPMAPITSNVFEMSEEERAERGIKPLPSTLHNAVKAFKADPLIQKALGEHLTQSFIDSKNLEWSKYNQSVSDWERDRYMGY

SEQ ID NO: 16498 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 16499 - protein, 159 aa, Vitis vinifera
LGNRSGQPYILQTNVFTGGKGDREQRIYLWFDPTKASHSYSVLWNTFLIIFLVDDVPIRVFKNSKDLGVKFPFDQPMKIYSSLWNADDWATRGGLEKTDWSKAPFVASYKSFHVDGCEASVEAKFCATQGKRWWDQREFQDLDSLQYRRLAWVRQKYTI

SEQ ID NO: 16500 - protein, 271 aa, Arabidopsis thaliana
MATSGAISGATVSSFFTKTTTTSNPSPKLHSSASLLSQKTVFQGVSLEDSKKSVSEIFAVSERKIGGLNGLRRFEIKARAAASKTIEVEVDKPLGLTLGQKQGGGVVITGVDGGGNAAKAGLKSGDQVVYTSSFFGDELWPADKLGFTKTAIQAKPDSVYFVVSRGAEVDVKKLNKRPAPPRFGRKLTETQKARATHICLDCGFIYTLPKSFDEQPDTYVCPQCIAPKKRFAKYDVNTGKAIGGGLPPIGVIVGLLAGLGAVGALLVYGLQ

SEQ ID NO: 16501 - protein, 335 aa, Arabidopsis thaliana
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSSPCKRRKLSGYSWVGDETSTSN

SEQ ID NO: 16502 - protein, 509 aa, Ocimum basilicum
MAALLLLLLLLPAIFLLHHLYYRLRFRLPPGPRPLPVVGNLYDVKPVRFRCFADWAQSYGPIISVWFGSTLNVIVSNTELAKEVLKEKDQQLADRHRSRSAAKFSRDGQDLIWADYGPHYVKVRKVCMLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPWLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPSEFRPERFLEEDVDMKGHDFRLLPFGAGRRVCPGAQLGINLVTSMIGHLLHHFNWAPPSGVSTDELDMGENPGLVTYMRTPLEAVPTPRLPSDLYKRIAVDL

SEQ ID NO: 16503 - protein, 163 aa, Zea mays
  unsure (1)..(163): unsure at all Xaa locations
KGXPXSSHDTTXTTTNAGAXXXNDNEAXTGGXRXPXXXEDYGGSEKXAHXARERXPERXXHARGAXAKGFXEXTHDXTXXTXADXRRAPGXRTPXXXRXXTXXHERGXPETNRDPRGXAXKXXTREGNGDRRGNNXPGXXNRDGNKDPDGNHADKPNPRAHXQ

SEQ ID NO: 16504 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 16505 - protein, 295 aa, Stigmatella aurantiaca
MYKQGHGFFWIGGPGEEAFNVPLGMLMKKGQGPAFDYLHAHYRQSATLLALGEEPIGALRQMKNTATDPYSGGRNFAGHFSKKAWNIAPVSSPIEVQYAIAPGTAMAQKRHGGDGITIVTGGDAGTAEGDFASCLIWSSRPANPLPILIIVTNNHWGISTAAEGQHGETHIADRGRAFNIRSKTINGNDPAESYRELKEAMEYVRQERKPFLLEARVSRLYGHSSASGANFVTNEVDCLKEFETRLEGEGVLTRQQMDALRHGYAEELAAAARLVRDEPLPSVDTLWNHVYAEKK

SEQ ID NO: 16506 - protein, 140 aa, Glycine max
MNSTEEGMQGIGIGIGCFQNDVVGQLELSPTMSNSSSSLSMELDESPESRIQRLISEHPVIIFTRSSCCMCHVMKKLLATIGVHPTVIELDDQEIAALPDTSAPSAFIGGTCIGGLESLVGLHVTGHLIPKLVQVGALWV

SEQ ID NO: 16507 - protein, 368 aa, Neurospora crassa
MATHNIVVFGGDHCGPEVVLEAIKVLKAIETNSPSAGKFNLQNHLLGGASIDKHNDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIVRIARLAGFLALAKNPPAKVWSLDKANVLATSRLWRKTVTDVISKEFPQLQLEHQLIDSAAMLLVKNPRALNGVVITSNLFGDIISDEASVIPGSIGLLPSASLGGIPDGKGKCNGIYEPIHGSAPDISGKGIVNPVGTILSVAMMLRYSLNLPKEADAVEAAVKAAIDNGTKTKDLGGNATTSDMGNAVVAELEKILKA

SEQ ID NO: 16508 - protein, 195 aa, Mitthyridium sp. Wall 3799
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFTTDSHSSIFDAKAGIALSDTFVN

SEQ ID NO: 16509 - protein, 465 aa, Oryza sativa
  unsure (1)..(465): unsure at all Xaa locations
DRSRISGINKPTPNKVTTQPPXDEFERSTRNQMLERGTEILKGNAYISKIRSFLLKMGLESSDLETVCVKDRLLTNECIDKIVGFALSHQLKHSTIPDPSSDVRFTLSSESLKHGVVRLESVESNPKSSNIRKSLKDIATENEFEKRLLADVIPPDEIGVTFEDIGALESVKETLKELVMLPLQRPELFSRGQLMKPCKGILLFGPPGTGKTMLAKAVATEAGANFINISMSSISSKWFGEGEKFVKAVFSLASKIAPSVIFVDEVDGMLGRRENPGEHEAMRKMKNEFMVNWDGLRTKDKERVLVLAATNRPFDLDEAVVRRLPRRLMVNLPDASNRRKILSVILAKEDLADDVDLEAVASLTEGYSGSDLKNLCITAAHLPIKDILEKEKKEKALAEAENRPLPQSFSSNDVRALRLSDFKHAHEQVCASVSSDSTNMNELIQWNDLYGEGGSRKKTTLSYFM

SEQ ID NO: 16510 - protein, 115 aa, Triticum aestivum
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHMWRK

SEQ ID NO: 16511 - protein, 205 aa, Triticum aestivum
MSRRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGHTQHGGLRPFGVSFIYAGWDPRRQFQLYLSNPSGNYGGWKGTSAGANNASAQSLLKQEYKEDCTLKEACGMAAKVLSKTMDSTKL

SEQ ID NO: 16512 - protein, 954 aa, Oryza sativa
MSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQLLQVIILLATGGANGGGYMASKYVVLAIYSVILILHGLINSLPIHWLSWFGQLGAFWNVAGVFALTILIPSVAKERASPEFIFTHFNTENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPAESPAAAFSTARSREGAVDDPRAVEEHGDQEPAANGVDQAAAANGGNQAVAANGQPPRSPAAALRRLHDLIATDAFHRDHQAPAPLLPPPHAALLLPSRPLGLPRPRRVHLRGVDIAARESHPVIRFAHADANLRRLPHARSSAARPRPVCSAGRPLPAPSPGPPAGPCCGCICRSRSARRPPTPPAARCSSPRRPPAAPPVARRRPLRPQLLPSPAAAITAAASPASPSNWREGETGGTRPAEGRLPLSSPRPLDADADVEAVPELTVVDPDGEATETAGGGRRRPSGGGGAPVPLLDLGHYAGVDEVGSGGGPRAPSGVSSARRRPHRRRGERHSRERQMWVMANDAALQKVAREGNLDVALLLQCVKPALRREGGNTQLATWTASTPLCLWRGLRWSTAATLSPPNPRRPLHNPCRRPCCRILGASA

SEQ ID NO: 16513 - protein, 430 aa, Thermobifida fusca
MDVSHKPHLRPSPLAASHRTLSPSTWMGTRTDSLRGFYVTSDRSSRLDDDPAFALHRGGKLEVRSTVEVNDQKSLSLAYTPGVARVCTAIADTPELADTYTWKNNVVAVVTDGTAVLGLGDIGPEASLPVMEGKSLLFKQFAGIDSVPIALACTDVDEIVETVVRMAPSFGGINLEDISAPRCFEIEQRLRERLDIPVFHDDQHGTAIVALAAIRNAARVTGRELSDLRAVVSGAGASGIAVSRMLIRGGIGDIAVADSKGLIYEGRPGLNKYKAELAAISNKAGLQGSIESALAGADVFVGLSAGEVPEEVVATMADNAIICAMANPNPEVHPDVARKYAAVVATGRSDFPNQINNVLAFPGVFRGALDVRATQITENMKLAAATALADLVGDDLAPDYIIPKPFDERVVPAVAAAVADQARKDGVARA

SEQ ID NO: 16514 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIWADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDADRNNSSRINLQDICKDLNQEGDDQMFVRKTSREIQGQNRRNLIHEDIAKAIKQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKIGII

SEQ ID NO: 16515 - protein, 308 aa, Brucella suis 1330
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRMKRMIALADIVKLSDEDLDWFGEKGSHDEIAAEWLKLGPKLVVITKGAHGAVVYTNHATVPVPGVKVDVVDTVGAGDTVNAGILASLHSQGLLTKDALANLSEDQIHSAVALGVRAAAVTVSRAGANPPWAHEMRD

SEQ ID NO: 16516 - protein, 86 aa, Oryza sativa
TYHEGLTVWTMGPILMEDYHVIKTVAHFNLKRIPERVVHAHGAIHKDVLECNHNVTDITCVDLVRSRGAQTHEIVRFSTDIHERRR

SEQ ID NO: 16517 - protein, 780 aa, Sulfolobus acidocaldarius
MRINILRVEYHSKTAHSILLQLDLFKKVKVICHMSQSIKFRVTEARQRDVGKKVARISETSMRKLNVEAGDYIEIIGQDGNSALAQVMPAYDISDDEIRIDGYIRKSIKVGIGDDVTVRKTNVSPASKVVLAPTQPIRFDNSFVEYVKDTLMDKPLAKGETLPIPIYTGTLELTVVNTQPSNYVYVTGSTNIEIREEPVKESSLAYPKVSWEDIGDLEEAKQKIREIVEWPMRHPELFQRLGIDPPKGILLYGPPGTGKTLLARALRNEIGAYFITVNGPEIMSKFYGESEQRIREIFKEAEENAPSIIFIDEIDAIAPKREDVTGEVEKRVVAQLLTLMDGIKGRGRVIVIGATNRPDAIDPALRRPGRFDREIEIRPPDTKGRKDILQVHTRNMPITDDVDLDKLAEMTYGYTGADLAALAKEAAIYALRRFVDEKKLNLDQPTIPAEIIKELKVSMNDFLNALKSIQPSLLREVYVEVPKVNWNDIGGLDNVKQQLREAVEWPLRFPELFTKSGVTPPKGILLFGPPGTGKTMLAKAVATESGANFIAVRGPEILSKWVGESEKAIREIFRKARQAAPTVIFFDEIDSIAPIRGLSTDSGVTERIVNQLLAEMDGIVPLNKVVIIAATNRPDILDPALLRPGRFDRLIYVPPPDKTARFEILKVHTKNVPLAEDVSLEDIAEKAEGYTGADLEALVREATINAMRSIYSMCDKQSRDECKGNMECYQKHIKECMNKTSFKVSKEDFEKALNVVKASLTQADIQRYERFSKELKRAIA

SEQ ID NO: 16518 - protein, 721 aa, Emericella nidulans
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 16519 - protein, 582 aa, Caulobacter crescentus CB15
MTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 16520 - protein, 354 aa, Bacillus subtilis subsp. subtilis str. 168
MELAAILFSLFFAMNIGASGAAASMGVAYGSGAIKKKTYALILCAVGVFAGAVIGGGEVVKTISSGIIPEQTITLTIVCIIIGAAALSLFTANLLGIPLSTSEVTVGAVVGVGVAYKVLFVNNLLIIVSFWVFVPLFAFGFTYFVSKLFRYFKIEVKSSKKQKILGIVLLVAGFFEAFSAGMNNVANAVGPLVAAGVLDVGKGTLYGGAFVALGALLLGRRVLETNGKKITRFSKGEGILLSGTGAGLVIISSVFGMPVPLAQVTSSSIIGIGMAKNGPNVFHKQVVQTMLKVWIVSPFLSLSISYLLVSLFLKADYYSIFIMVSVLLAAGGAISLTKAIRKERRSVHEQGGGI

SEQ ID NO: 16521 - protein, 314 aa, Sinorhizobium fredii
VMFDGSSIAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 16522 - protein, 366 aa, Oryza sativa (japonica cultivar-group)
MAQRVQEEDEQMMSTDDLIQAQIKLYHHCFAFIKSTALWAAIDLRIADVIHRNGGAATLSDLALNVGLHPTKLSHLRRLMRVLTVTGIFAVEDRNGEAMYTLTRVSRLLLNSDGEGTHALSQMARVLANPLAVISHFSIHEWFTTEKATTMTPFEVAHGCTRWEMIANDAKDGSVFNAGMVEDSRVAMDIILKESCGIFQGISSLIDVGGGHGAAAAAIATAFPNIKCTVLDLPHIVAEAPATHSNIQFIGGDLFKFIPAADVVLLKCLLHCWQDDDCVKILRLCKEAIPARDAGGKVIIIEVVVGIGSEEIVPKEMQLLFDVFMMYIDGIEREEYEWKKIFLEAGFSDYKITPVLGARSIIEVYP

SEQ ID NO: 16523 - protein, 419 aa, Arabidopsis thaliana
MQRLKQQQQQQQVMMQQALMQQQSLYHPGLLAPPQIEPIPSGNLPPGFDPSTCRSVYVGNIHIQVTEPLLQEVFAGTGPVESCKLIRKEKSSYGFVHYFDRRSAGLAILSLNGRHLFGQPIKVNWAYASGQREDTSSHFNIFVGDLSPEVTDAMLFTCFSVYPTCSDARVMWDQKTGRSRGFGFVSFRNQQDAQTAIDEITGKWLGSRQIRCNWATKGATSGEDKQSSDSKSVVELTSGVSEDGKDTTNGEAPENNAQYTTVYVGNLAPEVSQVDLHRHFHSLGAGVIEEVRVQRDKGFGFVRYSTHVEAALAIQMGNTHSYLSGRQMKCSWGSKPTPAGTASNPLPPPAPAPIPGFSASDLLAYERQLAMSKMAGMNPMMHHPQGQHAFKQAAMGATGSNQAIYDGGYQNAQQLMYYQ

SEQ ID NO: 16524 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAATRFGLSLVRALQGEQGVVECAYVEGDGQYARFFSQPLLLGKNGVEERKSIGTLSAFEQNALEGMLDTL

SEQ ID NO: 16525 - protein, 512 aa, Oryza sativa
MENAGAGDGAPKHYPGKMTVFVFIACLVASSGGLIFGYDIGISGGVTSMDPFLSRFFPSVYAKEKEVVDTNQYCKFDSEPLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILADNLINYFTDKIAGGWGWRVSLGLAAVPAVIMTVGSILLPDTPNSLLSRGKENEARTMLRRIRGTEDIGPEYDDLVAASEATKAIENPWRTLLERRYRPQLVMSVLIPTLQQLTGINVVMFYAPVLFKTIGFGGTASLMSAVITGLVNMFATFVSIATVDRFGRRVLFIQGGIQMIIAQFILGTLIAVKFGTAGVANISQGYAIVVVLFICLFVSAFAWSWGPLGWLVPSEIFPLEIRSAAQSVVVVFNMAFTFFIAQIFLMMLCRLKFGLFFFFGAMELIMTGFVLVFLPETKGIPIEEMDRIWGEHWYWSRFVGAGRNRVMQMASTNV

SEQ ID NO: 16526 - protein, 583 aa, Pseudomonas aeruginosa UCBPP-PA14
MQANHDGVLGVLSLIFWSLVWVVSIKYVIFVLRADNQGEGGVMALSALARRAAAPFGRLQTFVVVAGLIGAALFYGDSMITPAISVLSAVEGLEIAFDGLEHWTVPLALIVLIGLFLIQKHGTARIGILFGPVMVLWFGALAALGVYGVIQQPEVLQAMNPVWAVRFFGSHPGIGVAILGATVLALTGAEALYADMGHFGRKPIARAWFLLVLPALVLNYFGQGATILSNAEAARNPFYLLAPGWALLPMVALSTLATVIASQAVISGAFSLTRQAIQLGYVPRMTIQHTSSHEQGQIYIGGVNWALMVGVVLLVLGFESSASLAAAYGVAVTGTMLITTLLMGVVIWRLWKWPLWLGVPFFCVMLAVDSLFFAANLPKVIQGGAFPVIAGIVIFILMSTWKRGRQLLVERLDEGSLPLSVFISSMRVQPPHRVQGTAVFLTARTDAVPHALLHNLLHNQVLHEQVVLLTVVNEDSPRVPPDRRFEVEAYGDGFFRVILHFGFMEEPDIPAALRLCHLNELDFSPMRTTYFLSRETVIPSKRIGMARWREGLFAFLLKNANGNLRYFNLPLNRVIELGTQVEI

SEQ ID NO: 16527 - protein, 379 aa, Lactobacillus plantarum WCFS1
MQDEMLGIILAGGQGTRLGKLTKDTAKPAVPFGGRYRIIDFTLSNCANSGVNTVGVITQYQPLELNAHIGSGASWGFDSLNGGVTVLQPYSSSEGEKFFQGTAHAIYQNIEYIDQQDPKYLLVLSGDHIYKMDYDAMLKYHQEKKASLTVGVIHVTNEEAKRFGMMNTDATDRIIEFEEKPEHPKSDKASMGIYIFNWPTLRDYLVKSYATDKSLEDFGKNVIPSYLANNESVYAYAFKGYWRDVGTIKSLWQANMEFLSPHNRLNIGDRYWRIYSKAEVLPPMFLTETSQVNNAMVVDSCYVAGEIDHSILSQRVSVGMGSRVVDSMIMPGATIGKNVVIDHALIGEDAVIGDDAQIIGTTDKIAVVGYHETMGVEQP

SEQ ID NO: 16528 - protein, 379 aa, Ferroplasma acidarmanus
MVSSRVNGINESATVSMSNKAAELKAAGKTIYSFGIGEPDFTTPEEIIDYAFKEAREGKTHYTPSAGIMELREKIAEKMKKKNNIDATASNVLVTPTKFSLNLALYSIIDPGEEVLLPAPYYVSYPDIIKLNQGKMITVPTDENYEFDFQEMKKYISPKTKAFMFNNPVNPTGKVYSEKSLRALADFILENDLYLISDEIYEDLIYKGRMFSPGSIEEMKDKTVTLSGFSKSYAMTGWRIGYMVAPLDIIKAANKVQQQTLTCAPSISQYGAMKALEDEESVAKMRQEFAKRRDLTVSLLKEIDGITLYEPEGAFYAFPGYSTEKADDKLSMELLEKYNVIVTPGSPFGAPGHFRISYATSQDVIREGIGRIEKYFNNL

SEQ ID NO: 16529 - protein, 86 aa, Zea mays
IRWRVFEILSPITRKNNDHSSKSARYGTWGICFIYGTLHAINGLVAAGRNYENNICIRKACEFLLSIQLKTGGWAESYRSLEVRYF

SEQ ID NO: 16530 - protein, 497 aa, Pseudomonas syringae pv. tomato str. DC3000
MTTLTRADWEQRAQNLKIEGRAFIQGEYTAAASGETFDCISPVDGRLLAKVASCDAADAQRAVESARSAFDSGAWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVVLKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAADSAASAIAFNQGEVCTAGSRLLVERSIKDRFLPMVIEALGTWKPGNPLDPATNVGALVDTQQMNTVLSYIAAGHTDGARLVAGGKQILQETGGTYVEPTIFDGVNNAMRIAQEEIFGPVLSVLTFDTAEEAIQIANDTPYGLAAAVWTANLSKAHLTARALRAGSVWVNQYDGGDMTAPFGGFKQSGNGRDKSLHAFDKYTELKSTWIKL

SEQ ID NO: 16531 - protein, 319 aa, Prunus mume
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEKGYLKKAFYGTNGPTFGTKVSNYPPCPNPELIKGLRAHTDAGGLILLFQDDKVSGLQLLKDGQWIDVPPMRHSIVINLGDQLEVITNGKYRSVEHRVIAQTDGTRMSIASFYNPGSDAVIYPAPTLVEKEAEEKNQVYPKFVFEDYMKLYAGLKFQPKEPRFEAMKAVETNISLVPIATA

SEQ ID NO: 16532 - protein, 321 aa, Pseudomonas sp. SK-1-3-4
  unsure (1)..(321): unsure at all Xaa locations
CIGCHTCSITCKNVWTSREGMEYAWFNNVESKPGIGYPKEWENQDKWKGGWIRNANGTINPRIGGKFRVLANIFANPDLPSLDDYYEPFDFDYQHLHTAPLGEHQPTARPRPLISGKRMEKIEWGPNWEXILGTXFAKRRKDKNFDKIQADIYGEYENTFMMYLPRLCEHCLNPTCAVSCPSGAIYKREEDGIVLIDQEKCRGWRMCISGCPYKKIYFNWKSGKSEKCIFCYPRIEAGMPTVCAETCVGRIRYLGVLLYDADRISEVASTANEQDLYEKQLEIFLDPNDPAVIRAGLADRVPQSVIHSTQRSPVYKMAVDW

SEQ ID NO: 16533 - protein, 227 aa, Lycopersicon esculentum
MGRGRVQLKRIENKINRQVTFSKRRSGLLKKAHEISVLCDAEVGLIVFSTKGKLFEYANDSCMERILERYERYSFAEKQLVPTDHTSPVSWTLEHRKLKARLEVLQRNQKHYVGEDLESLSMKELQNLEHQLDSALKHIRSRKNQLMHESISVLQKKDRALQEQNNQLSKKVKEREKSAQQISGINSSSLFAHTDFYLGTYQSTNVIDNGKWKEVVLHSSKVQLIIL

SEQ ID NO: 16534 - protein, 354 aa, Ustilago maydis
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 16535 - protein, 199 aa, Yersinia mollaretii
SSIGGWKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 16536 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 16537 - protein, 238 aa, Paenibacillus polymyxa
MMKKKSWFTLMITGVISLFFSVSAFAGNVFWEPLSYFNSSTWQKADGYPNGQMFNCTWRANNVNFTNDGKLKLSLTSPANNKFDCGEYRSTNNYGYGLYEVSMKPAKNTGIVSSFFTYTGPSHGTQWDEIDIEFLGKDTTKVQFNYYTNGVGGHEKIINLGFDASTSFHTYAFDWQPGYIKWYVDGVLKHTATTNIPSTPGKIMMNLWNGTGVDSWLGSYNGANPLYAEYDWVKYTSN

SEQ ID NO: 16538 - protein, 166 aa, Glycine max
  unsure (1)..(166): unsure at all Xaa locations
MXGSGSGVVTAYGNGAITETKKSPFSVKVGLAQMLRGGVIMDVGNAEQARIAEEAGACAGMALERVPADIRAEGGEARMSDPQLIKDIKRAGTIPVMDKARSGHFREDQNREGTGIGXGDEREVVTLADEGGHIKKHQLAEYPLAGGRRNLRKDPRRNWEGDDKNR

SEQ ID NO: 16539 - protein, 487 aa, Glycine max
MASWLLGRSSRILIHQHHHLHKKYLPFLLGPFLNHNNSSCSSFPSTEPFRCRDAFPGKNSSPTLFRFSRHESTKAEAQLELEQDVATEDEPNQVIDFPGGKVGFTSEMRFISESPEKRVPCYRVLDDNGEIVKYSNYVQVSKEMGVKMYSDMVTLQTMDNIFYEVQRQGRISFYLTQMGEEAVNIASAAALAPDDIILPQYREPGVLLWRGFTLQQFVHQCFGNTHDFGKGRQMPIHYGSNQHNYFTVSSPIATQLPQAVGAAYSLKMDGKSACAVTFCGDGATSEGDFHAAMNFAAVMEAPVVFICRNNGWAISTPVEDQFRSDGIVVKGKAYGIWSIRVDGNDALAVYSAVHTAREIAIKEKRPVLIEALTYRVGHHSTSDDSTKYRGTDEIEYWKMARNPVNRFKRWVERNGWWSDKDELELRSSVRKQLMHAIQVAEKAQKPPLQDLFNDVYDQIPSNLQEQERLIRKTIEKHPKDYPSDVPL

SEQ ID NO: 16540 - protein, 509 aa, Bradyrhizobium japonicum USDA 110
MNIPSKPASIDVETHGNFIDGREVEAGNGAMLDVRNPATGDVIARIPNSTAEDIDRAMKSARAAFEGKAWGGMDTRARARLVNKLADAFEANLDSLYRLETLNNGRPVNETRAQLSRLPDFFRYFAGVALARRDSVIPVEGAYLNYTLRTPIGIVANCTPFNHPLMILCKSLAVVLATGCVTVVKPSEYTPLTTLKLAQIFTEAGLPPGVFNIVLGHGQSAGKMLAEHGDIDKLVLTGGTEAGRIAGSAAARVFAHQTMELGGKTPVMVFDDFDVDRAVNYAAFGAFIGAGQTCVCASRHIVQASIYDEFVEKLQAKTRTIRVGDPFDASTQMGPVISARQRDRVLTYAGYGHEDGARLVTGGVAAKVPGHDNGYFVEPTVFADVTSDMRIFQEEVFGPFTSVTPFKDEADALRLANDSPFGLAAAIRTRDVARAHRVAASVKAGIVWINDHHRLDPASPWGGVDDSGIGRECGTESFNDHFNTKSVMVATHEQPFDWYRDTANQKRLN

SEQ ID NO: 16541 - protein, 680 aa, Lactobacillus plantarum WCFS1
MRKQRIQERSLIGMLITLGVVYGDIGTSPLYVMNALINDAGQLKNATPDYVIGSVSLIFWTLMLITTVKYVLIALRADNHHEGGIFALYALVRHRAKWLIFVALIGGAALLADGTLTPAVTVTSAVEGLKGLPKLGAFSQYPWLVPLTVTVILLVLFMIQGFGTAVVGRSFGPMMLLWFTVIGIFGLINISQAPVILKAFSPVYAVQVLFNPANKMGIFILGSVFLATTGAEALYSDMGHVGKANIDATWPFVYTTLILNYLGQGAWMLTHYQDAAWRNATNVNPFYAMVPAGGQIAMIILATAAAIIASQALITGSYTLVDEAVGLKFLPRMIIKHPSNVRSQIYIGAINWLLCLVTLGIVWLFQTSAHMEAAYGLAITLTMLMTTILLSQWIHMKGHRALALALLFGFGALETVFLTASLTKFIHGGYLTLGLTLVIFLIMVVWFFGNRRRLRYNQANEQISLLDYRNQLIQLSHDDHLPVFATNLVYLAKVDHQHRVKRSILYSILDKRPKRAKVYWFITINETNRPYDCSYSIDMLGTRNIVEVQLNLGFRKSQHINLYLRQIVTNLIADHSIDPQYSRYGITQPRQVGDFKFVVQNQQIMDLASNPTMGQFDRLLIGGRVLLQNITPSPAIWYGLAFSDVLEETIPLFTKPATDATLTNLTVHHARTPQRNSRQP

SEQ ID NO: 16542 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 16543 - protein, 511 aa, Escherichia coli CFT073
MRKWANSARKAMLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEENFLDWGWRIPFFIALPLGIIGLYLRHALEETPAFQQHVDKLEQGDREGLQDGPKVSFKEIATKHWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMFPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 16544 - protein, 358 aa, Spinacia oleracea
AAVGEAATQTKARTRSKYEIETLTGWLLKQPMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWPDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 16545 - protein, 234 aa, Limonium latifolium
ETLLKAWPFLHTAILDASTEPFARVNGEPAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 16546 - protein, 358 aa, Haemophilus influenzae Rd
MQSYNIAVLAGDGIGPEVMAEAIKVLNRVQEKFGFKLNFNEFFVGGAAIEHCGYPLPAETLKGCDQADAILFGSVGGPKWTNLPPDQQPERGALLPLRKHFKLFCNLRPATLYKGLEKFCPLRADIAAKGFDMVVVRELTGGIYFGQPKGREGDGVQTKAFDTEVYYKYEIERIARAAFEAAMKRNKKVTSVDKANVLQSSILWRETVTEMAKDYPEVTLEHIYIDNATMQLIKSPESFDVLLCSNIFGDIISDEAAMITGSMGMLPSASLNEEGFGLYEPAGGSAPDIAGKGIANPIAQILSAAMMLRYSFNLNEAADAIESAVQKVLASGHRTADLADDSTPVSTAEMGTLITQAI

SEQ ID NO: 16547 - protein, 505 aa, Agrobacterium tumefaciens str. C58 (U. Washington)
MHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 16548 - protein, 459 aa, Oryza sativa
MASPLLLLLPLAVSSLLLPFAAAARVFSVADYGAAGDGARYDTGAIQAAVDACAAAGGGRVLLPAPGDYLTATVHLRSRVVLDVAPGARLLGGTRQADYPPESRRWYVVLAENTTGAGVTGGGEINGQGGAFVVTPNPQKNIMVSWNATGDCEGDECRPRLVGFIDSKDVTIHDITLNQPAYWCLHIVRCDNTMIHNVSIYGDFDTPNNDGIDIEDSNNTAITHCHIDTGDDAICPKSTTGPVYNLTATNCWIRTKSCAIKFGSASFFDFKKLVFDNITIVDSHRGLGMQIRDGGNVSDVVFSNIKMSTRYYHPLWWGRAEPIYITTCPRHPDSKEGTISDIQFINISSVSENGVFLAGSKHGLLRNLKFKNVDLTYKRWTNYSGGLYDYRPGCQKMVKHRTGGMMLEHISGLEIDNVRMRWSRGSLKGWDVDPLLFQPSTVDKLSFHDWQSLAVSRSF

SEQ ID NO: 16549 - protein, 345 aa, Burkholderia fungorum
MQLGMIGLGRMGADMVRRLTKGGQQCIAYDVQPAAVEKLKQDGVAGAASLEDLVAQLDKPRAVWLMVPAAVVDMTLEKLVPLLEPGDIVIDGGNSYYHDDIRRGAELAKRQLHYVDVGTSGGVAGRERGYCLMIGGEPEVVKRLEPVFSTLAPGAGTAPATPGRVSGSSTADQGFLHCGPLGAGHFVKMVHNGIEYGMMAAYAEGLNILRHANAGKHAREADAETTPLRRPELYQYELNLADVTEVWRRGSVIGSWLLDLIAGSLVSDADLKNYAGRVSDSGEGRWTVAAAIDEGVPTPVLSAALFARFSSRGEADFANRVLSAMRHDFGGHVEKAATPADGPKG

SEQ ID NO: 16550 - protein, 459 aa, Exanthemachrysis gayraliae
DPDYAIKETDVLAMFRLTPQPGVDPVECAAAVAGESSTATWTVVWTDLLTACDLYRAKAFRVDPVPNSSDQYFAYIAYDIDLFEEGSLANLTASIIGNVFGFKAVKALRLEDMRIPYAYLKTFQGPATGVVVERERMDKFGRPLLGATVKPKLGLSGKNYGRVVFEGLKGGLDFLKDDENINSQPFMRWRERFLFSMEGVNRAAAASGEVKGHYLNATAGTMEDMYERADYSRDLGSIIVMIDLVIGYTAIQSMAKWARKYDMILHLHRAGNSTYSRQKNHGMNFRVICKWMRMSGVDHIHAGTVVGKLEGDPLMVKGFYNTLLENKTDINLPEGLFFEQDWASLRKCMPVASGGIHCGQMHQLINYLGDDVVLQFGGGTIGHPDGIQAGATANRVALECMVLARNEGRDYIAEGPQILRDAARSCGPLQTALDLWKDITFNYTSTDTADFVETATANV

SEQ ID NO: 16551 - protein, 572 aa, Arabidopsis thaliana
  unsure (1)..(572): unsure at all Xaa locations
MADKSETTPPSIDGNVLVAKSLSHLGVTHMFGVVGIPVTSLASRAMALGIRFIAFHNEQSAGYAASAYGYLTGKPGILLTVSGPGCVHGLAGLSNXWVNTWPLVMISGSCDQRDVGRGDFQELDQIEAVKAFSKLSEKAKDVREIPDCVSRVLDRAVSGRPGGCYLDIPTDVLRQKISESEADKLVDEVERSRKEESIRGSLTSEIESAVSLLRKAERPLIVFGKGAAYSRAEDELKKLVEITGIPFLPTPMGKGLLPDTHEFSATAARSLAIGKCDVALVVGARLNWLLHFGESPKWDKDVKFILVDVSEEEIELRKPHLGIVGDAKTVIGLLNREIKDDPFCLGKSNSWVESISKKAKENGEKMEIQLAKDVVPFNFLTPMRIIRDAILAVEGPSPVVVSEGANTMDVGRSVLVQKEPRTRLDAGTWGTMGVGLGYCIAAAVASPDRLVVAVEGDSGFGFSAMEVETLVRYNLAVVIIVFNNGGVYGGDRRGPEEISGPHKEDPAPTSFVPNAGYHKLIEAFGGKGYIVETPDELKSALAESFAARKPAVVNVIIDPFAGAESGRLQHKN

SEQ ID NO: 16552 - protein, 377 aa, Streptococcus agalactiae NEM316
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDIRTVNGDYYDQILTYLRRSGSDQTIYMSCDMLCNIDLSQVIHLHNANGTQATVVYKKMPRSAIAEANQVLTIDESDHVVSLGKAVDNDDNQKMSAEIYVINTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLENGTRVVNSIIFPKVKIGEGATIENTIIDKCVKVAPGVTLKGSLDKPLVIPKFSEINEDIIQ

SEQ ID NO: 16553 - protein, 359 aa, Caulobacter crescentus CB15
MPKPGIMDIHAYVGGKSKVEGIAHPVKLSSNENILGSSDKAKDAYRNAVDRLHIYPDGKANFLRAAVAERYKLEPERLTFGDGSDEIFALLCQVYLEPGDNIVQGEHGFAAYAIGARACQGEVRMAKEVNHRVDIDEVIKCVDERTRLVFIANPANPTGTWLTGEEIRALHAALPPSVVLVLDGAYAEFCSDPHFEDGLELARTAENVIVTRTFSKIHGLAALRVGWGYAPEHIIAPIERIRPPFNTSIPAQEAAVAALFDDDFQDRSRALVEQWRPWLAQQLGGLGLEVTPSAANFVLATFPTTPGKTAPEAEAFLASKGYLVRAVGNYNLPHAIRITIGLEEQNRAVVELLSQFMGR

SEQ ID NO: 16554 - protein, 411 aa, Magnetospirillum magnetotacticum
MNSQHDFHRIKRLPPYVFAEVNAMKARARAAGEDIIDFGMGNPDQPTPTHIVDKLVEAARNPRAHRYSMSRGIPGLRKALSAYYQRRFAVDIDPEAECIVTLGSKEGLANLANAITSPGDIVLVPNPSYPIHPYGFIIAGGSCRFVPVTPDAEFLKALDRAVRHSVPKPIALVLNYPSNPTALLADLDFYGQVVEFCRHHGIWILSDLAYSEIYFDVAPPPSILQIPGAKDIAVEFTSMSKTYNMPGWRIGFAAGNKTLINALARIKSYLDYGAFTPIQVAATAALNGPQDCVDEIRALYKSRRDALIEGLAAAGWDIPSPPATMFAWAPIPKPFAHLGSLEFSKLLMREAQVAVAPGIGFGEYGDSHVRIGLVENVQRTRQAVRNIKTFLGSTGQVLEASEKQRAAGTEP

SEQ ID NO: 16555 - protein, 314 aa, Nicotiana tabacum
MADQENCVRVTRLAKKRAAEAMVQHLQQPNKKRVVLGEIRNLSNQIQMFDSEPLKPKCNKQTTKRKVKRSVSVKEREFREEDVDSKLDDDPQMCSAYVSDIYEYLHQMEIEKKRRPLSDYLEKVQKDVTANMRGVLVDWLVEVAEEYKLLSDTLYLAVAYIDRYLSIKVIPRQRLQLLGVSSMLIASKYEEIKPPRVEDFCYITDNTYTKKDVVKMEADVLQSLKFEMGNPTTKTFLRRFTRVAQEDCKNSNLKLEFLGCYLAELSLLDYNCVKFLPSLVAAAVIFLSRFTLQPKLHPWSVGLEQNSGYRACLL

SEQ ID NO: 16556 - protein, 523 aa, Nicotiana tabacum
MSADNNLQVLNALDVAKTQLYHFTTIVIAGMGFFTDAYDLFSISLVTKLLGRLYYTKPELLKPGTLPPTVSASVTGVALVGTLAGQLFFGWLGDKMGRKTVYGMTLIIMVLCSVASGLSFGSTPKGVMATLCFFRFWLGFGIGGDYPLSATIMSEYANKKTRGAFIAAVFAMQGFGILFSGIIALIVSAGFDHAYNVPSFQENPALSTVPQADYIWRIILMFGALPAGLTYYWRMKMPETARYTALVAKDAKRAAQDMGRVLQVEIDPEDAKIEQMSRDKTNKFGLFSWEFVRRHGLHLFGTTSTWFLLDIAFYSQNLFQKDVFSAIGWIPPAKTMNAVQEVYKIARAQTLIALLSTVPGYWFTVAFIDIVGRFAIQLMGFFFMTVFMFAIAIPYDHWTKKDNHIGFVAMYALTFFFANFGPNATTFVVPAEIFPARLRSTCHGISAAAGKAGAIVGAYGFLYAAQSKDPTKTDAGYPAGIGIKNSLIALGAINALGMVCTFCVPESKGKSLEEASQETITEE

SEQ ID NO: 16557 - protein, 815 aa, GIBBERELLA ZEAE PH-1
MDESQLQQPRRTYLFGYPLQHSLAPLLHSTIFESLNVPWTYDLIESIDKNDFIPKLKASDCVGAAVTMPHKVAWINECDEVTDEGRAIGAINTVFIRKDEVTGERKYIGTNTDCVGVRESFLQNSPGITEKSKGKPALVIGGGGACRSAVYALYKWLGASEIYLVNRLKEEADAVIESFSGLEDGPKMTYISSLEQAKQLETPVLIVGTIPDFEPSTEGEILARDIVTELVQKEEKGVLLEMCYHPRIVTRLYSLAEDNRWKVIPGTEAMIYQDIANMVKNIFARPKDDSANPAPPEVYNWRIYALAASAALGSSMFGYDSAFIGGTLSLPSFQERFNLASETGTALASLKANIVSTFQGGCFFGVLLCYYMTEKLGRRWVLILCGIIFNLGAIIQLVADGKLSFIYAGRVLTGLAVGASSMIIPVYISESGPPAIRGRLIGIFEIFLQFSQIIGFWVNYGVNIHISPTSDVQWHIPFGLQLAPGTLLVICMLFQPESPRWLLNAGRTDQARKVLQRLRQLPADHAYLNWEIDTVLKQIEEEKSMGADRSFFAKLREVVGPTNRPRLLLGIALMFIQNMSGINALNYYSPSIFKSIGFTGTSVGLLATGIFGIVKASATGLYMIWGVDALGRRQSLMIGSTGAAIALFYLGIYSKLSGSFDVGMVPAEKTPGAYVAIVMVYIFAVFYAISWNGIPWIFCAEIFPMAIRSICLVFTTCAQWLGQFIIVYSTPYMMTDITYGTFLLFACSVVFGLFFAFFLVPETKGISLEDMDVLFSRKGMPRTWRRQTNDVIAQRRAGEEVYSKQGESVVHEEKV

SEQ ID NO: 16558 - protein, 764 aa, Xylella fastidiosa Ann-1
MSNDTFKQAAIDYHRTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVATMAPDPVIFALANPIPEIMPEVVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKVGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQITEATLQACYRLRLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 16559 - protein, 315 aa, Streptomyces coelicolor
PLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 16560 - protein, 384 aa, Chloroflexus aurantiacus
MARKHPYEPLPWNDLPSVSWNFVWREPIGVCAQIIPWNYAFCMAAWKLGPALATGNTVVFKPSSLAPLSTLAIFQTIHDLNLLPKGVINLVLGPGGDVGEYLVTHPAVDKVAFTGSTEVGRKIMALAAPHIKRVTLELGGKNAMLILPDADLDLVVDGVLWGAFYHSGQLCEAGSRLLVPHALHDTLVERLVERVRGMRIGDPMDLETDIGPLISERQREKVEYYIAVGREEGATVVIGGGRPIGEAFANGHYVEPTIFTGVRPEMRIAREEIFGPVLSVIAYDEIGEAIRIANDSIYGLAASVWSRDLQHALSVVRRIRAGTVWINEHHVLNPRAPFGGYRQSGFGREMGRYGLDEYTEVKHIHVDLMQRRQGRLWWDTLLPE

SEQ ID NO: 16561 - protein, 841 aa, Bradyrhizobium japonicum USDA 110
MTALQDQSFQPNFPAPDQPIDELALAEIKGAILAKLRLAIGKDAGMATKHDWYQAAALALRDRIVHRWLTAEKHSYDAGRKRVYYLSLEFLIGRLFTDALNNMGLLKIFEVALGDLGVSLPELRKCEPDAALGNGGLGRLAACFMESMATLSIPAIGYGIRYDYGLFRQIINQGWQQEYPDEWLGFGNPWELQRPEVIYNIHFGGGVEHVDDKGRDRAIWHPGETVQAIAYDTPIVGWRGQHVNALRLWSARSPDPLKLDAFNKGDYVSASAEQSRAEAICKFLYPNDESPAGRELRLRQEYFFVSASLQDLVKRHLSSDGQLRSLSSKVAVQLNDTHPSLAVTELMRILVDLHNFRWDEAWKITVATLSYTNHTLLPEALETWPVELFERLLPRHLEIIYRINVQHLALAEARAPGDIDFRASVSLIDEKSGRRVRMGQLAFVGSHRINGVSAMHSDLMRETVFHDLNHLYPGRITNKTNGITFRRWLMLANPKLTDLLRETCGDAVLDDPTQLSLIEARASDVEFQKKFRAVKHHNKTALARLIGERLGIKVDPGALFDVQIKRIHEYKRQLLNVIETVALYQSMKDDPNGNWVPRVKIFAGKAAASYKYAKLIIKLINDVAEVVNNDPAIGGKLKVVFLPDYNVSLAEVIIPAADLSEQISTAGMEASGTGNMKLALNGAITIGTLDGANIEIRDHVGNENIAIFGMEAGDVMIRRKQGLDASDVIRSSPKLQRAINAVGAGEFSPGDPGRFESIAHALRYLDHYMVSADFDSYYEAQRAVDARWQVAPAWTRASILNVARMAWFSSDRTIREYAEEIWNVPVNPTTPLLPDLRDAAG

SEQ ID NO: 16562 - protein, 215 aa, Leptospira interrogans serovar lai str. 56601
MKISASILATKLTELVKTVPNYDPTAIDLMHMDVMDGNFVPQISFGEALTKEVKSLTSIPLDVHLMVAKPENHVFKYYEFNPYCITFHIETTDFPIRLAQEIKSHGTKVGVSLNPGTPVSSLENVLPYVDLILLMTVEPGFYGQKFIINGMDKIRKVKELIGSRPIEIEVDGGVNDTNIQELRKNGVDIVVVGAGLYKTGNPVENAKNLKYLARV

SEQ ID NO: 16563 - protein, 101 aa, Glycine max
MSGVTADEDKKPAGDGGGAHINLKVKGQDGNEVFFRIKRSTQLKKLMNAYCDRQSVDLNSIAFLFDGRRLRGEQTPDELEMEEGDKIDALLHQTGGGFPRP

SEQ ID NO: 16564 - protein, 237 aa, Streptomyces avermitilis MA-4680
MHAVILAGGKGVRLRPYTTALPKPLVPIGDQHAILEIVMRQLVNSGFTSCTIAIGHLGHIIRAYVGNGSQWGLRVDYSTEDSPLGTMGPLLTMLDRLPEHFLVMNGDILTDLDFRAVLRSHQADSAPLTIATYCRKVRIDFGVLTTDGKQVVGFTEKPTLDYRVSMGVYGLSRSTLDGYTPGLPLGFDELVLDLLRDGTPPAAHEFDGYWLDIGRPDDYDRANSEFTTHRDLLLKGA

SEQ ID NO: 16565 - protein, 353 aa, Oryza sativa
MGCSISGLNALYDAATGGGDVWINERRFRVLRQIGEGGFAFVYLVREHQASADAARGRSPSLASEDGTYAMKKVLIQSKEQLDLVKEEIRVSSLFNHPNLLPLLDHAVIAVKNQQGDWNHEAYLLFPVYIDGTLFDNAKVMQSRKEFYSTIDVLRIFQQLCEGLKHMHSFDPPYAHNDVKTGNVLITHRKGQAPLATLMDFGSARPARKEIRSRAEALRLQEWAAEHCSAPYRAPELWDCPSHADIDERTDIWSLGCTLYAIMYNVSPPERPLGESGGSLQLAIVNCTLKWPAGPSPPYPDALHQFITWMLQPQPAMRPHIDDIILHVRKAYGKIFVLNLLNILLTLFTQLHN

SEQ ID NO: 16566 - protein, 461 aa, Zea mays
MPPSKARRKRSLRDITATVATGTVANSKPGSSSTNEGKQHDKKKEGPQEPDIPPLPPVVVNIVPRQGLGCEVVEGLLVPSRKREYKPNSKYTVGNHPIYAIGFNFIDMRYYDVFAIASCNSVIIYRCLENGGFGLLQNYVDEDKDESFYTLSWTIDQVDSSPLLVAAGSNRIIRVINCATEKLDKSLVGHGGSIHEIRTHASKPSLIISASKDESIRLWNVHTGICILVFAGAGGHRHDVLSVDFHPTEVGIFASCGMDNTVKIWSMKEFWIYVEKSYSWTGHPSKFPTRNIQFPVLTAAVHSDYVDCTRWLGDFILSKSVKNAVLLWEPKPDKRRPGEGSVDVLQKYPVPKCSLWFMKFSCDFYSNQMAIGNNKGEIYVWEVQSSPPVLIDRLCNQECKSPIRQTAVSFDGSTILGAADDGAIWRWDEVDPAASSSKPDQAAAPAAGVGAGAGADADADA

SEQ ID NO: 16567 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 16568 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 16569 - protein, 488 aa, Listeria monocytogenes EGD-e
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 16570 - protein, 137 aa, Triticum aestivum
  unsure (1)..(137): unsure at all Xaa locations
MAVAALKVQLNALLSNMFATGMVDEQFQQLQSLEEGGTASGFVAEVATLFIEDADRIIADIAALLDQPVVDFDKVDAHVHQLKGSSSSVGAQKVKLACMHFRHFYEGXSREGSLMALSRLWNELXDMRERFHTMIQL

SEQ ID NO: 16571 - protein, 446 aa, Staphylococcus aureus subsp. aureus MW2
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 16572 - protein, 468 aa, Pseudochorda gracilis
IPYAKMGYWDAVYNVKDTDILALFRITPQPGVDPVETAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNSLLLTQLKINLAEGLFFDMDWASLRKCVPVASGGIHCGQMHQLLYYLGDDVVLQFGGGTIGHPDGIQSGATANRVALESMVLARNEGRDYVGEGPEILRHAATTCGPLKAALDLWKDITSDYTSTDTPDFVEVATEAK

SEQ ID NO: 16573 - protein, 257 aa, Saccharomyces cerevisiae
MKRSEKKSMSSALKNGIMERTQPEKVVQMQGTADLSTSKLGTKKYWDELYALELENFRRNPQDTGDCWFSDSDAEQKMIDFLVDNIGAYRISENASVVDLGTGNGHMLFELHQTEFQGKLVGIDYSEESVKLASNIAEATGVDNFISFQQADIFSGDWKPGKYDIVLDKGTLDAISLSGMKINGKLDVVDVYAGVVERILKKDGIFLITSCNFTQDELVKIIETDNLKMWKTIKYPVFQFGGVQGATICSVAFVKQN

SEQ ID NO: 16574 - protein, 207 aa, Borrelia burgdorferi B31
MMAKIIGISGGSGSGKTTVVSKISEFIPEFVLISQDNYYKSVGDYEHEFSKVNFDHPDAFDNNLFYEHLKNLKKNSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 16575 - protein, 487 aa, Silene latifolia
MSTQAHRNRLLGTENGNGGGGVKVVNNPKLTKKRPPLSNLTNHPRPSLVPSAITKSTKAKRDSSTGVRSTSFPAENPSATLNSKPSAVVPLKTAFTRSNVLVSCKASLPNGKGEQSHITRHPASCTMDTTPTPEDAQSVSMDESMSTCDSLKSPEVEYMDENDVAALCSIERKTSKNLYISDDMETTGSFCKREIVSAMEIDKVVDVDDNHMDPQFCSTIACDIYKHLRESETQKRPSTDFMEQTQKDINASMRAILVDWLVEVAEEYRLVPDTLYLTVNYIDRYLSGNAMNRQRLQLLGVACMMIAAKYEEICAPQVEEFCYITDNTYFKEEVLQMESGVLNFLKFEMTAPTTKNFLRRFVRAAQVMNEVPAFQLECLANYVAELSLLEYSMLKYAPSLIAASSVFLAKYMLTSSRPWNATLRHYTLYEASDLEECVKALHQLCLNSHISSLPAIREKYSHHKYKSVAKKHCPSSIPAEYFQNSSC

SEQ ID NO: 16576 - protein, 197 aa, Yersinia frederiksenii
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 16577 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIWCMNMNGGYICDALTAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 16578 - protein, 341 aa, Chloroflexus aurantiacus
MVRVAINGFGRIGRQSFKAMLEYYPEEFEIVAINDLTDAQTLAHLLRYDSTYGAFDGEVTVTEKAIVVEQDDIRYELLTLAERDPAALPWKELGVDIVIESTGRFTDAEKAKAHLAAGAKKVIITAPAKGEDITICLGVNDAKYDHEKHHIISNASCTTNCLAPVAKVLNDRFGIERGLMTTIHSYTMDQNLQDNVHKDLRRARAAAINMVPTTTGAAKAVALVIPELKGKFHGYAVRVPTPTVSMVDFSVLLSTKTSVEEINQAFIEASESEELEGILGVSHDPLVSTDFIGTTYSSVVDLPLTMSMGDDFFKIVAWYDNEWGYSVRVADLTALVADRFE

SEQ ID NO: 16579 - protein, 198 aa, Glycine max
  unsure (1)..(198): unsure at all Xaa locations
MAGLDMVAATAAANKDAPIPIFELLADAWADAWADAWADAWASSESSVEELGHHAGYYRLPRSKAARMFYFFFESRSSKNDPVVIWLTGGPGCSSERASIHENGPFQLTKNLSLVWNDYGWGKASNIMXVDQPSFTFFSYTSDESDIRHDEEGVSNDFFYFFHTFFIDLPHLTKNDFYITVESYTIHYIPSLSSIVHL

SEQ ID NO: 16580 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 16581 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 16582 - protein, 613 aa, Oryza sativa
MAQLQETYACSPATERGRGILLAGDPKTETIAYCTGRSVIIRRLDAPLDCWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANYYEGPPFKFKHSIRDHSNFVNCIRYAPDGSKFISVSSDKKGLIYDGKTGDKIGELSSEGSHTGSIYAVSWSPDSKQVLTVSADKTAKVWDILEDASGKLNRTLACPGTGGVDDMLVGCLWQNDYLVTVSLGGTFNVFSASNPDKEPVTFAGHLKTVSSLAFFPQSNPKTILSTSYDGVIMRWIKGVGYGGRLMRKNNTQIKCFTVAEEELVTSGYDNKVGNVFRIPLNGDQCGDAESVDVGGQPNALNLAIQKPEFALVTTDSGIVLLHKSTVISTTKVNYTITSSAVSPDGTEAIVGAQDGKLRIYSINGDTVTEEALIEKHRGAITCIHYSPDVSMFASADANREAVVWDRATREIKLKNMLFHSARINCLAWSPDNRLVATGSLDTCAIVYEIDKPASSRITVKGAHLGGVHGLTFVDNDSLVTAGEDACIRVWKLVPQ

SEQ ID NO: 16583 - protein, 424 aa, Zea mays; identical to SEQ ID NO: 4311

SEQ ID NO: 16584 - protein, 256 aa, Zea mays
MASTIGNNDRLTQLKAFDDTKAGVKGLVDEGVTIVPPIFHHLPDPHDATSNAHAAIPVIDLAAFSATNNDEAHAHQQLVAQVKAAAETVGFFQVVNHGVPAELLPRMLASVKSFNEEPADERRPYYTRDQARRVRYESNFDLFHSPAANWRDTVFFEDSAAPEEMPPAFRDVVPEYARQARGLAAQLLALLSEALGLHAGYLQRDAGCLGGPSLACHYYPPCPEPWLTLGTTRHSDPSFLTVLLQDAVGGLQVLLG

SEQ ID NO: 16585 - protein, 378 aa, Zea mays
CAVAAPCACCRQSLGLVKPLEEMLMAASAGAANPSQGSNPNPPPLAAPLTDAGSTERRARPQKEKALNCPRCNSTNTKFCYYNNYSLQQPRYFCKTCRRYWTEGGSLRSVPVGGGSRKNKRSSSSSSSSSSSAAAASASTSSSATSSSMASTPGAASKSPELAHEGAHDDLNLAFPHHGGLHAAEFAAFPSLESSNDMCDQGGGMTSNGRGGGAGPAVGALSATELLRSSGCYMPLQMPGGDYTAAGFALGEFRTPLLPPPSSQSPLGFSLDAHGPGSSGAAAAAGYGSSAGLPQGVPGNAGRLLFPFEDLKPPVSPGGGGVGGGGASATGGAGDGNSSHDQFDHNKERGGGGGRGAGAGHDTPGFWSSMIGGSGASW

SEQ ID NO: 16586 - protein, 178 aa, Glycine max; identical to SEQ ID NO: 15449
  unsure (1)..(178): unsure at all Xaa locations

SEQ ID NO: 16587 - protein, 105 aa, Petunia x hybrida
MAKLVPIFLLALFVISMFATTVLASHDPKRGHHHKGYGPGSLKPSQCLPQCTRRCSQTQYHNACMLFCQKCCNKCLCVPPGFYGNKGVCPCYNNWKTKEGGPKCP

SEQ ID NO: 16588 - protein, 86 aa, Saccharomyces cerevisiae
EVKPEVKPETHINLKVSDGSSEIFFKIKKTTPLRRLMEAFAKRQGKEMDSLRFLYDGIRIQADQTPEDLDMEDNDIIEAHREQIGG

SEQ ID NO: 16589 - protein, 488 aa, Gelidium americanum
MSNSVEERTRIKTQRYESGVIPYAKMGYWDPNYAVKETDVLALFRITPQPGVDPIEASAAVAGESSTATWTVVWTDLLTACDLYRAKAYKVDKVPNSDEQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHSHAGTVVGKLEGDPLMIQGFYNTLLMSHLDEDLIKGIFFEQDWASLRKVTPVASGGIHCGQMHQLLDYLGVDVVLQFGGGTIGHPDGIQAGATANRVALEAMVIARNEGREFVKEGPQILRDAAKTCGPLQTALDLWKDISFNYTSTDTADFVETPTANV

SEQ ID NO: 16590 - protein, 555 aa, Aspergillus oryzae
MRGYEFLSVLPLVAASWALPGSTPASVGRRQLPKNPTGVKTLTTANNVTIRYKEPGAEGVCETTPGVKSYSGYVDTSPESHTFFWFFEARHNPETAPITLWLNGGPGSDSLIGLFEELGPCHVNSTFDDYINPHSWNEVSNLLFLSQPLGVGFSYNDTVDGSINPVTGVVENSSFAGVQGRYPTIDATLIDTTNLAAEAAWEILQGFLSGLPSLDSRVQSKDFSLWTESYGGHYGPAFFNHFYEQNERIANGSVNGVQLNFNSLGIINGIIDEAIQAPYYPEFAVNNTYGIKAVNETVYNYMKFANQMPNGCQDLISTCKQTNRTALADYALCAEATNMCRDNVEGPYYAFAGRGVYDIRHPYDDPTPPSYYNKFLAKDSVMDAIGVNINYTQSNNDVYYAFQQTGDFVWPNFIEDLEEILALPVRVSLIYGDADYICNWFGGQAVSLAANYSQAAQFRSAGYTPLKVNGVEYGETREYGNFSFTRVYEAGHEVPYYQPIASLQLFNRTIFGWDIAEGQKKIWPSYKTNGTATATHTQSSVPLPTATSMSSVGMA

SEQ ID NO: 16591 - protein, 70 aa, Oryza sativa
  unsure (1)..(70): unsure at all Xaa locations
KRLSRKTLVQPYKPKGVEDVLLKTAQSGGXISKKGFXKRLISLLGQINTPPSKQTKVTFQRRRRVLYDND

SEQ ID NO: 16592 - protein, 212 aa, Streptomyces coelicolor A3(2)
MSARILVVDNYDSFVFNLVQYLYQLGAECEVLRNDEVSTAHAQDGFDGVLLSPGPGTPEQAGVCVDMVRHCAATGVPVFGVCLGMQSMQVAYGGVVDRAPELLHGKTSPVEHTGRGVFAGLPSPFTATRYHSLAAEPATVPAELEVTARTPDGIVMGLRHRELLVEGVQFHPESVLTEHGHRMLANWLVECGDQDAVARSAGLAPVVGRATA

SEQ ID NO: 16593 - protein, 292 aa, Glycine max
  unsure (1)..(292): unsure at all Xaa locations
MNRVWFLLFLLLISKCDHVWSSYAGSASSVINPSKVKQISWKPRFXLTDLECDHLISLAKSELKRSAVADNLSGESQLSDVRTSSGMFISKNKDPIVAGIEDKISSWTFLPKENGEDIQVLRYEHGQKYDPHYDYFTDKVNIARGGHRIATVLMYLTDVAKGGETVFPSAEEPPRRRGAETSSDLSECAKKGIAVKPRRGDALLFFSLHTNATPDTSSLHAGCPVIEGEKWSATKWIHVDSFDKTVGAGGDCSDNHVSCERWASLGECTKNPEYMIGSSDIPGYCRKSCKAC

SEQ ID NO: 16594 - protein, 523 aa, Candida tropicalis
MATQEIIDSVLPYLTKWYTVITAAVLVFLISTNIKNYVKAKKLKCVDPPYLKDAGLTGISSLIAAIKAKNDGRLANFADEVFDEYPNHTFYLSVAGALKIVMTVDPENIKAVLATQFTDFSLGTRHAHFAPLLGDGIFTLDGEGWKHSRAMLRPQFARDQIGHVKALEPHIQIMAKQIKLNQGKTFDIQELFFRFTVDTATEFLFGESVHSLYDEKLGIPTPNEIPGRENFAAAFNVSQHYLATRSYSQTFYFLTNPKEFRDCNAKVHHLAKYFVNKALNFTPEELEEKSKSGYVFLYELVKQTRDPKVLQDQLLNIMVAGRDTTAGLLSFALFELARHPEMWSKLREEIEVNFGVGEDSRVEEITFEALKRCEYLKAILNETLRMYPSVPVNFRTATRDTTLPRGGGANGTDPIYIPKGSTVAYVVYKTHRLEEYYGKDANDFRPERWFEPSTKKLGWAYVPFNGGPRVCLGQQFALTEASYVITRLAQMFETVSSDPGLEYPPPKCIHLTMSHNDGVFVKM

SEQ ID NO: 16595 - protein, 482 aa, Wolbachia endosymbiont of Onchocerca volvulus
MSQNKTLTTASGPPVADNQNSRSAGPRGPLLLDDFHLIEKLAHFNRENIPERRVHAKGSGAYGTFTVTQDITQYTSAKLFDSVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFGAIERGDFPKWRVCIQIMTEAQANAHYENPFDVTKTWSQKEFPLIEVGELELNRNPLNYFAEVEQAAFGPSNMVPGVGLSPDRMLQGRVFAYADAHRYRVGTNHQQLPVNAPRSPVNSYQRDGSMAFGSNGGAAPNYEPNSYADAPKQAPQYAEPALALSGAADRYDHREDTDYYSHAGALFRLMNDEQKALLINNIAGAMAGVSSDVVQRQLQYFFKADPAYGEGIASALGVSLN

SEQ ID NO: 16596 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLIMMILCSVASGLSFGNEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPRQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIIGAFGFLYAAQNQDKAKVDAGYPPGIGVKNSLIVLGVLNFIGMLFTFLVPEPKGKSLEELSGEAEVSHDEK

SEQ ID NO: 16597 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 16598 - protein, 425 aa, Corynebacterium glutamicum ATCC 13032
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 16599 - protein, 412 aa, Oryza sativa
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTCTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAGSSSISSADLFGRRDMDDSNLDLSAADLINRISFQASQDLSSLKNMAGETGKKLTSIASNFISDLDRIL

SEQ ID NO: 16600 - protein, 425 aa, Vibrio parahaemolyticus RIMD 2210633
MSEDNRQAATPEEEHRQKALDYHAYPTPGKIAVELTKPAETAGDLALAYSPGVAEPVREIAQNPDNVYKYTAKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLEDSTIVCLGAGAAAVACMELLIKCGAMREKIYMLDRKGVIHTRRDDLNEYKQLFANNTDKRTLEDVIEGADLFLGVSGPNLLPPEALKLMADKPVVFACSNPDPEIKPELAHAVRDDLIMGTGRSDYPNQVNNVLCFPFIFRGALDVRASEINDDMKLAAVDAIRALAKEPVPESVLKAAGVEKLEFGSDYIIPKPMDPRLLPRVAKAVAQAAVDSGVARIEMPENYMAE

SEQ ID NO: 16601 - protein, 227 aa, Zea mays
  unsure (1)..(227): unsure at all Xaa locations
MEKAGQHEHVIGIPVNNRAFGIEEPDFPSNGPAKNAAAGAGGRRRVTGDRVAQGLKEHVTLGPKLXRVGRRKLSLGARILRAGGVGKVFRRWFSSPVGGGGERLLRASQCYLSTTAGPIAGMLFVSTERVAFRSDRSLALPLTSPAGGGSGSGTTTVLRVPYKVSIPLRRVAAARPGQNRDRPEHKYVQVVTRDGFDFWFMGFVRYQASLQELEKAVAQSQSQSRSQ

SEQ ID NO: 16602 - protein, 299 aa, Desulfovibrio desulfuricans G20
  unsure (1)..(299): unsure at all Xaa locations
MTEQQTPAADDSPRAGNGQTAFAPFARKMRLHGLSEGLIRLFNSYYDEIVARHTGYLHEAELLPVSAADLPHVDSLESFREAGRQAARQAVVIKLNGGLGTSMGMTHAKSLIPVFGEMRFLDIIMQQALLQQKECGGPLPLALMNSFSTHEETLQALADIREEDCRQCTPVCFVXXXXXXXXXXXXXXXXXXXXXXXXXXXXXXXXXXXXXXXXXXXXXXXXXXXXXXXXXXXXXXXTRRPVCFAGHFRRAGRSALPRAPLCLCLQLRQSGCRAGYAHSRIHGRQRVALYHGGGSAHSF

SEQ ID NO: 16603 - protein, 115 aa, Helicobacter pylori
EFRFPDSSSNPYLAFAAILMAGMDGVKNKMDPGEAMDINLFKLTLDEIREKGIKQMPHTLRRSLEEMLADKQYLKEGQVFSEEFIQAYQSLKFNAEVFPWESKPHPFEFITTYSC

SEQ ID NO: 16604 - protein, 202 aa, Colletotrichum lindemuthianum
MSSNRNYDFLIKLLLIGDSGVGKSCCLLRFSEDSFTPSFITTIGIDFKIRTIELDGKRVKLQIWDTAGQERFRTITTAYYRGAMGILLVYDVTDERSFNNIRTWFANVEQHATEGVNKILIGNKCDWEEKRVVSTERGQQLADELGIPFLEVSAKSNINIDKAFYSLAADIKKRLIDNQKNEQPAASGVNVGESSGSGGKCC

SEQ ID NO: 16605 - protein, 356 aa, Microbulbifer degradans 2-40
MSVIKAHIRAMSAYKPPLDGRNPDTNVLLDFNERTLPVSEKVQRALIDYIQSGRLQMYPAYGNIVELIANYAGVGVDQLMITNGSDQGIELVFRSVCGAGDKVVIPGPSFAMYSQCAKIENCSIVSPQYTREHGFPLQEVLDAIEPDVKVVVVSNPNNPCGTLLARDGVEAILKAASTHGNNAAVLVDECYFEYTQATVADLVAAYPNLIITRTFSKTWGIPSLRFGYIISCAENINALLNVRGPYDINQLAVVAVRAALENFSDVSSYIDEVMLRSKPVLEAFLDEQGIEYWPSSTNYIWTFPVGPEAVELALRAAGILVRPKADADGRLGLRITLGTLEQTKKAIEVLRVATAS

SEQ ID NO: 16606 - protein, 439 aa, Pyrococcus woesei
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLSKDGENVFMGEEGLSEIALHFIGGILKHAKALIAVTNPTVNSYKRLVPGYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 16607 - protein, 295 aa, Helianthus annuus
NLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHE

SEQ ID NO: 16608 - protein, 452 aa, Brucella suis 1330
MNPADEKPYAVISAGSAADIDLAVAAARRAFPAWSETPAEERIAYIRRIAEIYESRLDEMAKTISMEMGAPIKLARESQAAAGLSHTKAFIAACENFEVEEVLSPKYPNQTAVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTSQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 16609 - protein, 456 aa, Callophycus oppositifolius
YVVKETDILALFRVSPQPGVDPIEASAAVAGESSTATWTVVWTDLLTACDLYRAKAYKVDAVPNTSDQYFAFISYDIDLFEEGSIPNLTASIIGNVFGFKAVKALRLEDMRIPVAYLKTFQGPATGVISERERMDKFGRPFLGATVKPKLGLSGKNYGRVVYEGLKGGLDFLKDDENINSQPFMRWKERYLYAMEGVNRSIAATGEVKGHYLNVTSATMEDMYERAEFAKQLGSIIIMVDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALEAIVIARNEGRNYVAEGPQILQDAAKTCGPLQTALDLWKDITFNYTSTDTADFVETPTANV

SEQ ID NO: 16610 - protein, 395 aa, Aspergillus fumigatus
MYFKYTAAALAAVLPLCSAQTWSKCNPLEKTCPPNKGLAASTYTADFTSASALDQWEVTAGKVPVGPQGAEFTVAKQGDAPTIDTDFYFFFGKAEVVMKAAPGTGVVSSIVLESDDLDEVDWEVLGGDTTQVQTNYFGKGDTTTYDRGTYVPVATPQETFHTYTIDWTKDAVTWSIDGAVVRTLTYNDAKGGTRFPQTPMRLRLGSWAGGDPSNPKGTIEWAGGLTDYSAGPYTMYVKSVRIENANPAESYTYSDNSGSWQSIKFDGSVDISSSSSVTSSTTSTASSASSTSSKTPSTSTLATSTKATPTPSGTSSGSNSSSSAEPTTTGGSGSSNTGSGSGSGSGSGSSSSTGSSTSAGASATPELSQGAAGSIKGSVTACALVFGAVAAVLAF

SEQ ID NO: 16611 - protein, 610 aa, Oryza sativa (japonica cultivar-group)
MAQLQETYACSPATERGRGILLAGDPKTETIAYCTGRSVIIRRLDAPLDCWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANYYEGPPFKFKHSIRDHSNFVNCIRYAPDGSKFISVSSDKKGLIYDGKTGDKIGELSSEGSHTGSIYAVSWSPDSKQVLTVSADKTAKVWDILEDASGKLNRTLACPGTGGVDDMLVGCLWQNDYLVTVSLGGTFNVFSASNPDKEPVTFAGHLKTVSSLAFFPQSNPKTILSTSYDGVIMRWIKGVGYGGRLMRKNNTQIKCFTVAEEELVTSGYDNKVFRIPLNGDQCGDAESVDVGGQPNALNLAIQKPEFALVTTDSGIVLLHKSTVISTTKVNYTITSSAVSPDGTEAIVGAQDGKLRIYSINGDTVTEEALIEKHRGAITCIHYSPDVSMFASADANREAVVWDRATREIKLKNMLFHSARINCLAWSPDNRLVATGSLDTCAIVYEIDKPASSRITVKGAHLGGVHGLTFVDNDSLVTAGEDACIRVWKLVPQ

SEQ ID NO: 16612 - protein, 464 aa, Bacillus anthracis str. A2012
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 16613 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 16614 - protein, 308 aa, Salmonella bongori
INGFGRIGRIVFRAAQKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAGIALNDNFVKLVSWYDN

SEQ ID NO: 16615 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 16616 - protein, 546 aa, Thinopyrum elongatum
MGLDLGAIALKYTGLAVSDHGSIVAINIFIALLCGCIVFGHLLEGNRWVNESTTALVLGLITGGVILICSKGVNSRILIFSEDIFFIYLLPPIIFNAGFQVKKKQFFRNFATIILFGAAGTLISFVIITFGAMGLFSKLGVGPLELGDYLAIGAIFSATDSVCTLRVLNQDEAPLLYSLVFGEGVVNDATSVVLFNAIQNIDINHFDVFVLLQFIGKFLYLFFTSTVLGVAAGLLSAYIIKKLCSARHSTDREVAIMILMAYLSYMLSMLLDLSGILTVFFCGIVMSHYTWHNVTESSRVTTKHTFATLSLIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 16617 - protein, 359 aa, Haemophilus influenzae Rd
MAKLLDIVKPGVVTGEDVQKVFAYAKEHNFAIPAVNCVGSDSVNAVLETAARVKAPVIIQFSNGGAAFYAGKGIKPTSGTRPDVLGAIAGAKQVHTLAKEYGVPVILHTDHAAKKLLPWIDGLLDAGEKHFAETGRPLFSSHMIDLSEESMEENMAICREYLARMDKMGMTLEIEIGITGGEEDGVDNSDVDESRLYTQPSDVLYVYDQLHPVSPNFTVAAAFGNVHGVYKPGNVKLKPSILGESQEFVSKERNLPAKPINFVFHGGSGSSREEIREAIGYGAIKMNIDTDTQWASWNGILNFYKANEAYLQGQLGNPEGPDAPNKKYYDPRVWLRKMEESMSKRLEQSFEDLNCVDVL

SEQ ID NO: 16618 - protein, 444 aa, Capsella bursa-pastoris
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHHLKSVIEKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTTECGKEVQIVGDDLLVTNPKRVAKAIAEKSCNALLLKVNQIGSVTESIEAVRMSKKAGWGVMTSHRSGETEDTFIADLAVGLSTGQIKTGAPCRSERLAKYNQLLRIEEELGSEAVYAGVNFRTPVEPY

SEQ ID NO: 16619 - protein, 157 aa, Carica papaya
MDVRMFVLESPILSSLRQLMELQDTETEKSFNAPTRTYVRDAKAMAATPADAKEYPNSYVFVIDMPGLKSGDIKVQVEDDNVLQISGERKREEEKDGVKYLRMERRIGKFMRKFSLPDNANTDAISAVCQDGVLTVTVQKLPPPEPKKPKTIEVKIA

SEQ ID NO: 16620 - protein, 486 aa, Vibrio parahaemolyticus RIMD 2210633
MEMKTHYIDGAMYIGCSEEHFTTYNPANGEPLANIKQANQSDMEAAIESAKRGFEVWSAMTAIERSRILNKAVAILRERNDELAALEVADTGKPIQEAIAVDITTGADVIEYYAGLAPSLQGEQQPLNENQFFYTRREPLGICAGIGAWNYPIQIAMWKSAPALAAGNAMIFKPSEETPLTALKLAEIYSEAGLPDGVFNVVQGDYRVGQMLTAHPDIAKVSFTGESGTGKVVMGDSAKTLKQVTMELGGKSPLIVFDDAKLDDAVSAAMVANFYTQGEVCTNGTRVFVHESIYDDFVAQLKTRTEKLVVGDPLDENTQIGALISKEHESKVLSAIESAKASGATLLTGGYKVTDNGLQNGNFVAPTVFIDCDDSMSHVQQEIFGPVMSVLKFSEEAEVIERANDTDYGLAAGVFTQNLSRAHRVIHKIQAGICWVNAWGDSPAEMPVGGYKQSGIGRENGVETLKHYTQTKSVLVQLSDFESPYA

SEQ ID NO: 16621 - protein, 301 aa, Ralstonia metallidurans
MSAQAMTRRPLDGTAIGLMVLLCAAWGLQQVIIKVTAPLMGAVLQAGVRSAIAALLVFGFAAWRGTPLWERDGTLRAGLVAGLLFGAEFFCIFVGLGHTTASRMAVFLYTAPIFTALGLHLFVPGEHLHRGQWLGVVLAFCGIALAFADGIASPSTQGSTVIGDVLGMVAGALWAATTVVVRGSKLSGAPASKTLLYQLGVSAVMLLLMALAAGQAHTVEITGFVVASLFYQSVLIAFASYLIWFWLLRQYLASRLSVFSFLTPLFGVAFGVLLMHDHVGVRFALAAVMVLGGIVLVNRRA

SEQ ID NO: 16622 - protein, 140 aa, Oryza sativa
  unsure (1)..(140): unsure at all Xaa locations
RGRAPRYYSEIVKEAINLALDKGPNFIDPLARXVRNVGTRKIFKTEDVTTGCLLYAALLEDIGIDLPLAPALFGEVVARLSLSCGLSFEVVEEILKAVEDTYFRKGIFDAVMKTMGGNSSGQAILSSHAVVIDACNKLLK

SEQ ID NO: 16623 - protein, 617 aa, Streptomyces avermitilis
MTEQATGAHHPQPRPRSGGQQSAPEHVTGRAQSLIRSLEEVGAETVFGIPGGAILPAYDPLMDSKRVRHVLVRHEQGAGHAATGYAQATGKVGVCMATSGPGATNLVTPIADAHMDSVPLVAITGQVASKAIGTDAFQEADIVGITMPITKHNFLVTKAEDIPRTIAEAFHIASTGRPGPVLVDIAKDALQARPPSSGPPTPDLPGYRPVTKPHAKQIREAAKLITQAKRPVPYVGGGVLKAKATAELKVLAELTGAPVTTTLMALGAFPDSHKLHVGMPGMHGAVTAVTALQKADLIVALGARFDDRVTGKLDTFAPYAKIVHADIDPAEIGKNRAADVPIVGDAREVIADLVQAVQKEHSEGHAGDYTAWWKDLKPWRDTYPLGYEQPDNGSVSPQQVIERIGQLAPEGTIFAAGVGQHQMWAAHYVKYEQPATWLNSGGARTMGYAVPAAMGAKAGQPDRTVWAIDGDGCFQMTNQELTTCALNNIPIKVAIINNGALGMVRQWQTLFYNQRYSNTVLHSGPGRGRKAAERRHPRPRLREAVGGHGLLRDPCESPDDLDKVIAEANSVNDRPVVIDFIVHEDAMVWPMVAAGTSNDEVMFARDVRPDFGDNEDD

SEQ ID NO: 16624 - protein, 489 aa, Oryza sativa
MGSRPVDEVLDAAAAGVHYSTLRLDELNINGSMTGEEQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNLPKDIANRHVLLLDPILGTGNSAVQAISLLLKKGVQETNIIFLNLISAPQGVHVVSKRFPRVKIVTSEIEFGLNDDFRVIPGMGEFGDRYFGTDDYQSSTPFFCDEKNRVRLL

SEQ ID NO: 16625 - protein, 537 aa, Schizosaccharomyces pombe
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRS

SEQ ID NO: 16626 - protein, 492 aa, Streptomyces coelicolor A3(2)
MTHELFDSKGLLGSAPAAFVAGEYELDSSHGTLPVINPANGQLVAEVPSSSSSTVDRAVTAAVAAQREWGRRSHVARAAVLEAVRDAIAVHADELARIVSVEQGKPLSDARGETEGACAFFDFAISQKYRAVGSMMASEPGRSLGVREEPIGVVAAILPWNFPVAIFARKVAPALMAGNAVVLKPSELTPLSALALARLCRLAGVPDGLLSVVCGEGKDTGRALVTHPGVGMVTMTGSTRGGREILAQVADQIIPVSLELGGKAPFIVFEDADLDAAVEAAADARLWNTGQVCTCNEVTYVHADLHDEFVRRVVDRFASVTPLDPFAAGSRLGPLVAERERTRVQGMVDAAVAAGARVRTGGGRPDGEQYQSGAWFAPTVLTNVRPEMDIARREVFGPVLPIIPFDAEAEVVSAANSTAYGLTAYVYTRDLSRAMRMIDALEFGEVYVNQAGPEQVQGFHTGWKSSGLGGDDGPHGYEKYLRRKTVYVRHAV

SEQ ID NO: 16627 - protein, 537 aa, Oryza sativa (japonica cultivar-group)
MAPAAAGRVPLSRRRSTAALLLVALALVLGVQLRSAAARPDKEMREKFYGKLVTNGSGNATGDGSIAEMFGRVLDKEFSDSDTPEAPDKSSFNNSISDHQAVLETVAVITHDKKKNDSEQANSSKPFQIGDMFGGQNENSDDLETVIDKEDNVFVMSNRKTKYPTLQLDLRLIKDLVVIIVSATAGGIIFSCLGQPVIVGYLLAGSLVGPGGLNFISEMVQVETFAQFGVVFLLFALGLEFSLTKLKAVGPVAVIGGLLQIVLFMFLCGLTAALCGAKSSEGVFVGAFLSMSSTAVVSKFLVEKGSTNALHGQVTIGTLILQAACIIRIYNCCIYDDLVICSSILETDDSAIIAVRSQYHTNELYQLASVAFCLLLAWCSDYLGLSLELGSFLAGVMISTTDFAHHTLEQVEPIRNLFAALFLASIGMLIHVKFLWNHVDILLAAVILVIIVKSVVVTVVVKAFGYSIRTAFVGKMYLLLLGTTALSLVTTPLIFKLIPVVMHLGILMRWFPSESSMQNELPLQDKATMLEAYNRSL

SEQ ID NO: 16628 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKNCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSA

SEQ ID NO: 16629 - protein, 251 aa, Arabidopsis thaliana
MAPKNSSWNPFDDEKEAAKSFSLNPFDDDDDDKEVEKRFTSSLKPSGGKENQTVQELESYAVYNSEETTKTVQGCLKVAEEIRCDASKTLVMLNEQGDQITRTHQKTVDLDHHLSRGEKILGRLGGVFSRTWKPKKSRSITGPVITKGDSPKRKVIDLKTREKLGLNPSLKPKSKTLPEAVDAYQKTQIAKQDEALTDLSALLGELKNMAVDMGTAIERQTNELDHLQDNADELNYRVKQSNQRARYLLRK

SEQ ID NO: 16630 - protein, 314 aa, Rhizobium etli
VMFDGSSIGGWKAINESDMVLMPDTETVHMDPFFAQSTMVILCDILDPVSGEAYNRDPRGTAKKAEAYLKASGIGDTIFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 16631 - protein, 142 aa, Photobacterium profundum
MSVSAKMDKIGFKMTDKTDAYWRKKLTEDQYHICREKGTEASFSGTLLHNRETGLYSCTCCEAPLFVSDNKYDSGCGWPSFDAPVNKEAVRYIEDNSHGMLRTEIRCANCDSHLGHVFPDGPNTTGERYCVNSVSLVFNTEE

SEQ ID NO: 16632 - protein, 468 aa, Azoarcus sp. BH72
MKKLFAILLTALTVGFAGGVIAQENTAAPTAPAAVEAPAATDAAPAAAEAPAAAEEVVATVNKGDVAWIMTATLLVLFMALPGLALFYGGLVRTKNMLSVLMQVMVVFSLIAVLWAFYGYSLAFTEASPFIGSLDKLFLSGVSNSTLADTFSADAKLPEYAFIAFQATFAGITCALIVGSFAERIKFSAVLLFSVIWFTFCYLPICHMVWGPGGFLLGDGALDFAGGTVVHINAGVAGLVGAYMVGKRIGFGRESMAPHFVTLTMVGASMLWVGWFGFNAGSNLEATAGAALAFINTLLATAAAVLAWSLGEAMFKGKPSMLGAASGAVAGLVAITPACGSVGPMGAIIIGLLAGFVCLWGVNGLKRMLGADDSLDVFGVHGLGGILGAILTGVFTAPSLGGTGAEDFAMGHQVWVQTYSVLITIVWSAVVAFIGYKIADMFVGLRVPEEEEREGLDVTAHGETAYHY

SEQ ID NO: 16633 - protein, 566 aa, Bacteroides thetaiotaomicron
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQIKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWSKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFIKNCSNGEKETKSLPKVSSNISHRIKVSTFTNPNTVINQSLFS

SEQ ID NO: 16634 - protein, 222 aa, Phanerochaete chrysosporium
TLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEGGMWVKMREAQAMGQVA

SEQ ID NO: 16635 - protein, 840 aa, SYNECHOCOCCUS SP. WH 8102
MTSSQPLDLRLPTPGCYNDPERAGLDAKSVFDGMTEHLFFTLGKLAPTASRHDLYMALSYAVRDRLMMRYLATTEAMRAHPQKSVAYLSAEFLIGPQLNNNLLNLGIQQEAEAALRNFGIESLQQILDVEEEPGLGNGGLGRLAACYMESLASLKIPATGYGIRYEFGIFDQLIRDGWQVEITDKWLKGGWPWELPQPDEACFVGFGGRTESYIDDKGSYRSRWIPAEHAIGIPHDVPVLGYRVNICDRLRLWRADATESFDFYAFNIGDYYGAVEEKVGSETLSKVLYPNDGTDEGRRLRLKQQHFFVSCSLQDMLRSLDNRGLPVEDFPKYWTVQLNDTHPAIAVAELMRLLIDDRHMDWDKAWDITSRSVAYTNHTLLPEALEKWDLNLFSSLLPRHLELIYEINRRFLQQLRLRYPGNDAIQRKLSIIDEDGSKAVRMAHLATIGAHHVNGVAALHSDLVKTDLLPEFAELWPEKFTNVTNGVTPRRWVALANPELSTLLNEHIGEDWISNMENLRKLEERQNDQGFLEHWGNTKLSVKRKLASYIHRNTGVLVDPSTLFDVQVKRIHEYKRQHLNVLQVITQYLRIKNGQADGMAPRTVIFGGKAAPGYYMAKLIIRFINGIAETVNADPDMDGRLRVVFLPDYNVKLGEQVYPASDLSEQISTAGKEASGTGNMKFAMNGALTIGTLDGANVEIRELVGAENFFLFGKTVEEINDLKRSGYNPGAFINAMPELQEALRLIEMGHFSNGDSELFRPLLDNLTGHDPFFVMADFADYLRAQEAVSLAWTDRMHWNRMSLLNTARTGFFSSDRSIGEYCENIWNVGPLNVDITCDVR

SEQ ID NO: 16636 - protein, 799 aa, Actinobacillus pleuropneumoniae serovar 1 str. 4074
MALTAQFSALFERGLQAYCEERSLNPTQLSDQQWYQLVAQVAHQAALQFFPKNAPLVDTRKVNYLSMEFLVGRLLGNNLQNLGVYQYVVDEVAKYGKTLVDILEQETDPAFGNGGLGRLAACYLDSMASLAQPAVGYGLHYQYGLFKQSFDWAGRQHEEGDAWGRDFFPLQSHRADFRQPVGFAGEVRHIAGDKYEWQPAWTIYGEAFDLPVVGYKGVQQPLRLWQGYSETAFDLAKFNDGDYLDSESMVIDASKITKVLYPNDNHQNGKELRLMQQYFHCACSVADIIKNHLAKGRILDQLAEFEVIQLNDTHPAIAIPELMRLLLDQYGYSWEKAWSICSKVFAYTNHTLLPEALEQWDQNLVAKLLPRHLIIIERINLELYQQVKACFDEDELANVWDETAIIANNRVRMANLCVVGSFAVNGVAQIHSDLVVSDLFPAYAKLFNGRFHNVTNGITPRRWIRQANPLLSALLDQHIEGDWTQNLELLRQIEPLAENSAFQTAYAEIKQQNKQALTKVIEETLGIQVNQNAIFDVQIKRFHEYKRQHLNLLNIIATYQELKANPDMPFVPRVFIFAGKAAPGYFMAKQIIQAINNVAHVINHDPDMQGKLQVAFLPNYSVSLAEKIIPAADVSEQISLAGKEASGTGNMKLALNGAITLGTLDGANVEIAEFAGEENVVIFGHTVESVRELREKGYVSREYYEQDEVLRKAIDALADGSFAGGNKEIFEPLVYDLLNKDYFCVLADFASYREAQQEVAKRYQNQTAWLKSTILNTARLGSFSSDRSIRDYQTRIWKK

SEQ ID NO: 16637 - protein, 1145 aa, Cymodocea nodosa
MAAVEHGPLSYRMFLEEVNGTVTGEVKSESSPQDGIIFVGVSLVLGIASRHVLRGTRVPYTVALLLLGVGLGALEYGTSHGLGKLGSGIRIWANINPDLLLGVFLPALLFESSFAMEVHQIKRCIVQMILLAGPGVLTSTFCLGSLLKLTFPYNWDWKTSLLLGGLLSATDPVAVVALLKDLGASKKLSTIIEGESLMNDGTAIVVYQLFYRMVLGEKFGVGSIIKFLSEVPLGAVAVGLAFGIVSVLWLGFIFNDTIIEITITLAVSYIAFYTSQEAIELSGVLTVMTVGMFYAAAARTAFKGESQESLHHFWEMVAYIANTLIFILSGVVIGESVMRNESNFESDGATWGYLILLYAYVQLSRVAVVAILFPLLRYFGYGLEFKEALILIWAGLRGAVALSLSLSVKRASDSLDSPSLKQEVGTLFVFFTGGIVFLTLIINGSTTQFLLHFLAMDKLSAAKIRILNYTKYEMLNKAIEAFEDLGEDEELGPADWPTVKKYITCLNDLEGEKEHPHTITESENHLHHINLSDTRVRLLNGVQAAYWEMLDEGRITQTTGILLMQSVDEAMDTVSHEPLCDWKALKSYVHFPKYYKFLQMSRIPQRLVTYFTVERLESACYISAAFLRAHRTARRQLHEFIGESEIAAAVINESNAEGEDARNFLEDVRISFPQVLRAVKTKQVTYSVLKHLSEYVQTLEKVGLLEEKEMLHLDDAVQTDLKKLLRNPPLVKMPKVRELLDTHPLLGVLPKQVRVPLENSTKETMKIKGTTLYKEGSKPNGIWLISNGVVKWASKTLSNRQSLHPTFLHGSTLGLYEVLVGKPFICDMITDSLVHCFFIEAEKIVPLLRSDPDIEEFLWQESSIVIAKLLLPPVFEKLSLQEVRGLIAERSRMNIYISGEFIEIPHNSVCILLEGFLKTQDAHKSLIASPAVLLPSNVELSFLSLESSGIAAASFCHRGNSYMAEARARVILFEIGATEPPSPLQRRQSSWMSHSIEPQKLQEHGGLMSWPENLQRARSHQILKDSDHHANNMSTRAMELNIFGSMVEGTHKHHAGVPKTSLDFSKSYHRIPSETSPLPLVSTRSEGESLGKRLGQREKPKLLPPPPKPVTGASESKPAEDNSSDESGAEEEIIVRIDSPSHIDI

SEQ ID NO: 16638 - protein, 200 aa, Glycine max
MADQGLEGSQPVDLQKHPSGIVPTLQNIVSTVNLDCKLDLKTIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 16639 - protein, 288 aa, Glycine max
  unsure (1)..(288): unsure at all Xaa locations
MAPAMRIVFGLLTFVTVGMIIGALSQLAIIRRLEDSYGTDSLPFRRLRGLDTDRHLQLPRGVPFWNNDKEAEILRLGYVKPEVLNWSPRIILLHNFLSMEECDYLRALALPRLHISTVVDTKTGKGIKSDVRTSSGMFLNPQERKYPMVQAIEKRISVYSQIPIENGELMQVLRYEKNQYYKPHHDYFSDTFNLKRGGQRIATMLMYLSDNIEGGETYFPLAGSGECSCGGKLVKGLSVKPIKGNAVLFWSMGLDGQSDPNSVHGGCEVISGEKWSAXTKWMRQTTPT

SEQ ID NO: 16640 - protein, 282 aa, Zea mays
MACSHLAAAGGSSPAAAAVVRSPTHSPAAAFARLRSTPRFSSAGLSVKGSRAAFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPEGKKIILNFVRFIEELEKQRS

SEQ ID NO: 16641 - protein, 204 aa, Oryza sativa
  unsure (1)..(204): unsure at all Xaa locations
FKXGQTKMKSVXVDFLVGAGNQRTWLAGPSDHGKHGGXGQAAPQPEGAEEHSQRGGVDDMVSSNAILYEPGEHPDHVIVIKYIPYVGDSKRAVDEYTSEIFMGGKNTIVLHNTCEDSLLAAPIILDLVLLAELSTRIQLKAEDQDKYHSFHPVATILSYLSKAPLVPPGTPVVNALAKQRAMLENILRACVGLAPENNMMLEYK

SEQ ID NO: 16642 - protein, 429 aa, Pseudomonas aeruginosa PAO1
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 16643 - protein, 110 aa, Thermosynechococcus elongatus BP-1
MIRPIADTYPLLPLSKAQMGQRQEIINSHKRLWDKTMATDLIMTILPGMTVKVTNPNDTYYQFQGIVQRITDGKVAVLFEGGNWDKLVTFQASELEPVVVTPKEKAKAKK

SEQ ID NO: 16644 - protein, 473 aa, GIBBERELLA ZEAE PH-1
MEKLSETTPNGTSPRTFALNHSRPRSSFKGCSRISDYELLGKLGEGTFGEVHRARLRKTGALVALKKIIMHHEKDGFPITALREIKLLKLLSHKNILRLEDMAIEHPTRQTDKRKKPIVYMATPYMDHDLSGLLDNPSVQFKEPQIKCYMLQLLEGLRYLHDSRILHRDMKAANLLINNKGILQIADFGLARHYDGRTPESGVPMGEGKRDYTGLVVTRWYRPPELLLQLRQYTPAIDVWGVGCVFGEMLYGKPILAGESDAAQLDIIWDLMGSPNEENMPRWKSLPGADHLTPRPRTGNLETRFRQYGSGAVSLLKELLRLDWRTRINAVDALQHPWFKMQPLPLEPHEIPTYEESHELDRRKFHDRKAALPPAPKGGTVGVGPDANGATAGFNSNEPYGNGRNGVNGGRRRDDRPPPPRDDRPPPRDDRRRRNSREDRRFDRDRGTMSRSRSPRHDRSRDRDRPDHNGYRR

SEQ ID NO: 16645 - protein, 185 aa, Glycine max
SCAIAFNTCQKIFYHILDFAPGINYYDIRKKCKGDWCYDFRNVETLLNLPKVKSVIGVSNDLQYVSCSKRVHEAMMQDYMRNMEVEILSLLEDGIKLLVYVGEEDLICNWLGNSRWVHAMKWSGKKAFGKSPTVKFVVDGSKAGSLNSYGPLSFLKVHEAGHLVPMDQPKAALQMLQSWMAGKLT

SEQ ID NO: 16646 - protein, 166 aa, Zea mays
  unsure (1)..(166): unsure at all Xaa locations
MASLHSLAAVSVIATKGTAVTSSCSSTLRPLSSLRFKPRELSIFPNHRKGKGGAIKAQSKEASLPPPTVGEGDALTSMKHLLLPVIDRNPYLSEGTRQAAATTTSLATKYGADITGVVIDEEKRESSSEHETXQVSNIRWHLSXEGGFEEFKLLESLGEGKKALPL

SEQ ID NO: 16647 - protein, 317 aa, Mycobacterium tuberculosis H37Rv
MAKDLVATVPDLSGKLAIITGANSGLGFGLARRLSAAGADVIMAIRNRAKGEAAVEEIRTAVPDAKLTIKALDLSSLASVAALGEQLMADGRPIDLLINNAGVMTPPERVTTADGFELQFGSNHLGHFALTAHLLPLLRAAQRARVVSLSSLAARRGRIHFDDLQFERSYAPMTAYGQSKLAVLMFARELDRRSRAAGWGIISNAAHPGLTKTNLQIAGPSHGRDKPALMERLYKTSWRFAPFLWQEIEEGILPALYAAATPQADGGAFYGPRGRYEVAGGGVREAKVPAAARNDADSKRLWEVSEQLTGVSYPKSR

SEQ ID NO: 16648 - protein, 642 aa, Oryza sativa (japonica cultivar-group)
MPPPTMMLPPSPGDSDPSGSRDMDDEDLVEDLLVTVNSARAFVEFRRTQRKECANLLRWLELVLPLLEELRDSAPPLTEDAYHRLALLGRAFSAARRLLRSCHDGSKIYLALESEAVQGRFRAVYEKMNSALDGMPYSELAISDEVKEQVELMNAQLTRCKKRADTQDIELSMDLMVILDNKEGERNADRAILERLAKKLELQTLADLRAETMAIKKLISERNGQSGDSTKQIIELLNKFKEVAGVDEKNVLGEVSVTKSLDKCPSLMIPNDFLCPITLAIMRDPVIVATGQTYERRSIQKWLDSGERTCPKTRQRLSHMSLAPNYALKNLILEWCDKNKVELQKREPEPVAEQDDEHQRGAEDIPSLVEGMSSIHLDVQRKAVKRIRMLSKECPENRTLIADSGGIPALIGLLACPDKKVQENTVTSLLNLSIDESNKRHITKGGALPLIIEILRNGSAEAQENSAATLFSLSMIDENKLTIGRLGGIAPLVELLQNGSIRGKKDAATAIFNLVLNQQNKVRATQAGIVPALLKIIDDKALNMVDEALSIFLLLSSNAACCGEIGTTPFIEKLVRLIKDGTPKNKECALSVLLELGSKNKPLLVHALRFGLHEDLSKIAKNGTSRAQRKATSLIQLARKCY

SEQ ID NO: 16649 - protein, 200 aa, Glycine max
MTFQPVPTLLLLLLLASANSHFALAGKRKVHIPDELDDVFDDEEDDAWREWGKKPEPPFPSSDISKLDPSQIQQEMMKRHAGPVIGFVKLRPGSRRTPDMVAEFAMKWTHVLRTGAVGVRFMGVDLNTIMFNLESIKDLEELKEFVLDQSEAYEIKMGDQFFRRSGDPPLDEVIEKYNSEKAKADNADSEEIDPNVKTEL

SEQ ID NO: 16650 - protein, 535 aa, Oryza sativa (japonica cultivar-group)
MGMEVAAARLGPLYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIRAIFPATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKRTWRQQVVIWWAGLMRGAVSIALAYNKFTRSGHTQLHGNAIMITSTITVVLWSTMVFGMMTKPLIRLLLPASGHPVTSEPSSPKSLHSPLLTRMQGSDLESTTNIVRPSSLRMLLTKPTHTVHYYWRKFDDALMRPMFGGRGFVPFSPGSPTEQSHGGR

SEQ ID NO: 16651 - protein, 322 aa, Azotobacter vinelandii
MSNLLEQLRQHSIVVADTGDLEAIRRFAPEDATTNPSLILKAVQSGQYDGLVARVLGEVGGARSPEAAVDDACDRLVVALGERILASVPGRVSTEVNARLSFDREASIAKARRLVGLYEAAGIGRERILIKLAATWEGIRAAEVLEKEGIPCNLTLIFGFAQARACAEAGVHLISPFVGRILDWYRQADPATAYAPAEEPGVRSVRRIFDYFRRHAYPTVVMGASFRNVGEILALAGCDRLTISPALLEELAASEGVLAPALADTGEREARPAQRLGEAEFRWQMNEDAMATEKLAEGIRGFEADQLKLEALLRARLAGGVA

SEQ ID NO: 16652 - protein, 334 aa, Nostoc sp. PCC 7120
MSDQANQGDLEIRPSPLLKVINDLHSKYKSLKEGIVANYIPELAKVNPDLFSISIVTVDGQVYQVGDYQQLFTIQSISKVFAYGLALEDHGRDYVLTRVGVEPTGEAFNAIILDEQSKRPYNPMVNAGAIATTSLIKGAGATERLNRVLEMFRRYIGHDVFVDISVFTSERSTGHRNRAMAHLMLNFGMIDRNIEEALDLYFQQCAVMVNCHDLAVMAATLANRGVNPITGEQAVNSRYIKDILSVMYTCGMYNFAGEWAYKVGIPAKSGVCGGIMAVVPNLMGIAVFSPPLDIRGNSVRGVKVCEELSQQLGLHLFECMKVGNGEWGVGNCEC

SEQ ID NO: 16653 - protein, 180 aa, Solanum tuberosum
MASSVMSSAAVATRGNGAQASMVAPFTGLKSAASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 16654 - protein, 252 aa, Microbulbifer degradans 2-40
MPKTILITGASSGFGEACAKIFAKQGNTLILVARRKQLLDELADNLGKQCDVYTAQVDVSQPASIATFFEQLPSKLGPIDTLINNAGLALGLESADKADINDWETMINTNCLGLVHFTRQVLPSMVANNLGHIVNIGSTAGKWPYPGGNVYGATKAFVQQFSRNLRADLLGKNIRVTNIDPGMAETEFSNIRFKGNNEKAEQVYHNAKPLTAQDIAETVQWVCNRPAHVNINSLEIMPVCQAWGGWEIDRNC

SEQ ID NO: 16655 - protein, 303 aa, Streptomyces fradiae
MNDRPRRAMKGIILAGGSGTRLRPLTGTLSKQLLPVYDKPMIYYPLSVLMLAGIREIQIISSKDHLDLFRSLLGEGDRLGLSISYAEQREPRGIAEAFLIGARHIGGDDAALILGDNVFHGPGFSSVLTGTVARLDGCELFGYPVKDAHRYGVGEIDSGGRLLSLEEKPRRPLEPGRHRLYLYTNDVVEIARTISPSARGELEITDVNKVYLEQGRAAHGAGAVVAWLDMGTHDSLLQAGQYVQLLEQRQGERIACIEEIAMRMGFISAEQCYRLGQELRSSSYGSYIIDVAMRGAAADSRAQ

SEQ ID NO: 16656 - protein, 197 aa, Syrrhopodon albovaginatus
GGAKKVVISAPSKDAPMFVMGVNEEKYTSEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKTALKEASEGKLKGILGYTEDDVVSSDFITDSRSSIVDAKAGIALSDTFVKLV

SEQ ID NO: 16657 - protein, 359 aa, Oryza sativa
MDKHTCKLCFRRFHNGRALGGHMRSHVMAAAAAAAYCPSSPAMSLASTSSTEIEMDEKKEMTKKTEQEKTLTSYVLRENPKRSYKVSAGEFSGGGGGGGGRGKSSVVQDGESDTESSPPRGGAGSFFAVSRRRSKRARRRRRAPDPEPASSVSDATTEEDVAMSLLMLSRDSWTRSRSEHETHHRGASSEAEQNNNNVVNVFDEEDEDARDVAGEDHDEELSYGGGEAAAARHRTSRFQCGACRKVFRSYQALGGHRASLKRGKGGGCVPPPRPAPASSAAAPAIHECPFCFRVFDSGQALGGHKRAHMPSGGARPSPSPSPAKCGESSGSIDLNMPATMEDDFELSAVYDAEFASTRQ

SEQ ID NO: 16658 - protein, 339 aa, Azorhizobium caulinodans
MAARKPSARAEAAPAGVPTFTKEQELLAYREMLLIRRFEEKAGQMYGMGLIGGFCHLYIGQEAVVVGMQMAMKQGDQVITGYRDHGHMLATGMESRGVMAELTGRKGGYSKGKGGSMHMFSIEKQFFGGHGIVGCAGVAGHRPRLREPLSAENGSVSVTYFGDGAANQGQVYESFNMAELWKLPVVYVIENNKYAMGSAVSRASAQTDFSKRGQSFNIPGEQVDGMDSAQPVKAAGERALEFARSGKGPYILEMQTYRYRGHSMSDPAKYRSKEEVQKMRTEHDPIEQVRNRLLEAGLVTEDELKKVDAEIRDIVNDAADFATHDPEPDPSELYTDIVR

SEQ ID NO: 16659 - protein, 490 aa, Pseudomonas syringae pv. tomato str. DC3000
MARFELQKLYIDGGYVDASNTETFDSINPANGEVLAKIQRASKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKGEFEAKILERVKRIRPGNPEDENINFGPLVSFEHMESVLGYIAKGKEQGARLLCGGDRLTGGVFDKGAFVAATVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 16660 - protein, 516 aa, Arabidopsis thaliana
MGLGGDQSFVPVMDSGQVRLKELGYKQELKRDLSVFSNFAISFSIISVLTGITTTYNTGLRFGGTVTLVYGWFLAGSFTMCVGLSMAEICSSYPTSGGLYYWSAMLAGPRWAPLASWMTGWFNIVGQWAVTASVDFSLAQLIQVIVLLSTGGRNGGGYKGSDFVVIGIHGGILFIHALLNSLPISVLSFIGQLAALWNLLGVLVLMILIPLVSTERATTKFVFTNFNTDNGLGITSYAYIFVLGLLMSQYTITGYDASAHMTEETVDADKNGPRGIISAIGISILFGWGYILGISYAVTDIPSLLSETNNSGGYAIAEIFYLAFKNRFGSGTGGIVCLGIVAVAVFFCGMSSVTSNSRMAYAFSRDGAMPMSPLWHKVNSREVPINAVWLSALISFCMALTSLGSIVAFQAMVSIATIGLYIAYAIPIILRVTLARNTFVPGPFSLGKYGMVVGWVAVLWVVTISVLFSLPVAYPITAETLNYTPVAVAGLVAITLSYWLFSARHWFTGPISNILS

SEQ ID NO: 16661 - protein, 446 aa, Chondrus armatus
  unsure (1)..(446): unsure at all Xaa locations
LFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKALGSIIVMXXXXXXXXAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGVDVVLQFGGGTIGHPDGIQAGATANRVALESMVIARNEGRDFVAEGPQILQDAAKTCGPLQTALDLWKDISFNYTSTDTADFVETPTANV

SEQ ID NO: 16662 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 16663 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 16664 - protein, 91 aa, Oryza sativa (indica cultivar-group)
RDAKARYVKFHWKPTCGVSCLMDDEATLVGGKNHSHATQDLYDSIAAGNFPEWKLFVQVIDPEEEERFDFDPLDDTKTWPEDEVPLRPVGR

SEQ ID NO: 16665 - protein, 361 aa, GIBBERELLA ZEAE PH-1
MATTTVQITAPAEYTTVQLLTPNGPVSRRVRCGKPRTPTLEEMPIIDLSSIDGDESARKALSTQIKAAAENTGFFYVSNHGIPQDLIEEALQQCKNFFDQSQDDKDRVAFTKAGKFCGYHGVGSTQINNKETKDNKETFSMRYDTRIDPSHDCVDDINSNFDSIDFVWNGTSHLTKFRPVLTEFYQRRLTLARKLIRLFALALELPEDYFDSIITTPGADAVHLHYPGTEETDDIDVGIGSHTDIQCVTLLWQDMSGGLQVLSADDEWLDARPIEGTLVINIGDFLQRLSNNRFKSTVHRVYNRQKASRYAMPFFLGFNPDAVCEVVPTCTDAEHPPLYEPISCGEWRSSRLRLAETGKLN

SEQ ID NO: 16666 - protein, 194 aa, Griffithsia japonica
ARGLYPSIMPLQNVNGSASQSLQDFKGVTDKSAVQVVEEKLQNMNKASVDPNCIMSDSELAGFLELYGRYMTERSKKAQINWDLIEQPSENMLQRYDTLIAASDADRTALLSKLAVLKLNGGLGTSMGCKGPKSVIEVRGDTTFLDLIVQQIEGLNKSHPGADVPLLLMNSFNTDTETARIIPKYQHTNVTSPL

SEQ ID NO: 16667 - protein, 122 aa, Zea mays
  unsure (1)..(122): unsure at all Xaa locations
TDKAIERLLSQLRKESLKIIPVNASSEVDALYSFKTEFSVNEDLHLIXLYSEKGISKDRILIKIAATXEDIKAXEILQXDHGINTNLTLMVSLIQAIGAAEAAAYLISPFVGXILDWFKPLP

SEQ ID NO: 16668 - protein, 405 aa, Zea mays; identical to SEQ ID NO: 5187

SEQ ID NO: 16669 - protein, 203 aa, Zea mays
MAAIASASPRTLIPPRPRHHGAAPSPSTSDVSSLRLLRAHPRHVRRSRGVSISMPVARSRSFVFSPRAVADSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVGVLAAQQSPDNPNWFQGTADAVRQYLWLFEEHNVM

SEQ ID NO: 16670 - protein, 504 aa, Zea mays
MRKPAALVVSTAVFAAAAVAAVMARQRLREARRWARAGAVLRDLQERCAAPVERLRQVADAMVAEMRAGLASNDSEGDSGSSVLLKMLVTYVDSLPSGDEKGLFYALDLGGTNFRVLRIQFGGKEQRIVKQESKTVSIPQHLMSRGSNELFDFIAAALAKFIASEGEGFYLPEGMQRQLGFTFSFPVKQNSVASGTLIKWTKGFAIDEMVGKDVVAELNKAIKRQGVDMEVTVLVNDTVGTLAAGRYVDNDTVAAVILGTGTNAAYIEHMDSIPKWCGPPPESGNMVINMEWGNFRSTHLPLTEFDVALDAESLNPDEQIYEKLISGMYMGEIVRRVLLKMAQDASLFSDNVPLELEVPYILRTYHVLMMHQDTSPDLRTVGNKLKEVFRIEDTCFKTRKLVVDVCEVVASRAARLAAAGIHGILKKLGRDVASPDKQKTVIAVDGGVYKHYTFFAQCMESTLRDLLGEGVASSLVIKLAEDGSGTGAALLSASYSQRLQAVDD

SEQ ID NO: 16671 - protein, 143 aa, ASPERGILLUS NIDULANS FGSC A4
MADAELEEIRRARLAQLQQSGGPPRAPSEGNQDEQRKQVEAPTHTTPTAERRATILNQILEPEAADRLGRIRLVKESRATDIENRLIMLAQTGQLRQKVTEEQLKQLLNAVAENQRKDEEEQQKIVFSRRKGGWDDDDDLLDL

SEQ ID NO: 16672 - protein, 412 aa, Salmonella typhimurium LT2
MADFRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 16673 - protein, 314 aa, Rhizobium galegae
VMFDGSSIGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFP

SEQ ID NO: 16674 - protein, 215 aa, Synechocystis sp. WH 8501
MTYVTSSARAEMSELRRLKTLLPPELQNWVMVEGSTEINPPLIRCEELGRDEVEIQIDLAKWESLAIDQRNLLFWHEVARIQNDTIPREGWEMAALAIGLGGAVGELWVQDGLLLLLALGLCGISGYRLWQKNNGERKLKESIEADEKAIALATRFGYTLPNAYKSLGSAFKTLIEQTPNRRQRKQYESRLQALRRSAGKAKEKMQQDKGKRPLR

SEQ ID NO: 16675 - protein, 919 aa, Neurospora crassa
MAGRKHAPRMRELRDGQNDSNQNSQNDSDGLLSAEPSQQSYLSVPSSPSSYRRTRANMNQAGGAPDERTSLLGATRASRIRIASAHGTPRAPNLSRNQSYGGEGTDTVRSNPPTRHHSRANSWGQRLIRALADRQEEPVSEPKGSVFPDDRVWYDQFTSTDWVHDSIADAHRVKALRSRKDFWGRVYILFDGAQGWILSALVGFIIAVLAYIVDVTESTFFDFKDGYCARGWLISEKRCCPHGPCTDWRDWGEVMHGWPFGERWTEFVIYLGLVITLASVSCLLTLTTKTVVPSAYRLSTLDENLAAAPVSPGGNGDDGGDSPNGNGTPSRRASVAPPAAAPSMIYYSAAGSGVAEVRVILSGFVLHGFLGLKTLIIKTVGLVLSVASGLSLGKEGPYVHIATCVGNIACRLFSKYDRNDAKRREVLSAAAAAGVAVAFGAPLGGVLFGLEEVAYFFPAKTLFRTFFCCITAALTLKFLNPYGTHKIVMFQVRYLIDWEYFELVSFILVGVLGGAAGALFIKASRKWAVTFRRIPIIKKHPLLEVVLVALVTGLIGYWNGLTKLPVAKLLYNLAAPCDDRDNNLEDLGLCPDSKADIPPILWHLLWAFLIKGLLTIITFGIKVPAGIYVPSMVVGGLMGRLIGHMVQWLVLAFPDTAMFSSCNKVSSVSCIQPGVYGLIAAGSTMCGVTRLSVTLAVILFELTGSLDYVLPFSLAILVAKWTADAIEPLSIYDLLTEMNSYPFLNNKHKPVFTSELIDIVPRVRRERIIDISNSPLVPATSLRSKLESLHRAGELDGGLPIIRNDILVGLIPAPDLEYALDNLPDESTALCLMANVPSIDDSDDEEGGGRRDPTDFTPYIDPAPVALDIRSPMDLVYELFVKLGLRYICILRDGKYAGMTHKKTFVKYMRELEEQEGKE

SEQ ID NO: 16676 - protein, 457 aa, Sphacelaria arctica
DYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNVTAATMEQIYERAEFAESVGTVIVMIDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEERDYVSEGPEILRIAAATCGPLKAALDLWKDITFEYTSTDTPDFVEVATESN

SEQ ID NO: 16677 - protein, 715 aa, Clostridium stercorarium
MENKPVYLDPSYSFEERAKDLVSRMTIEEKVSQMLYNSPAIERLGIPAYNWWNEALHGVARAGTATMFPQAIGMAATFDEELIYKVADVISTEGRAKYHASSKKGDRGIYKGLTFWSPNINIFRDPRWGRGQETYGEDPYLTARLGVAFVKGLQGNHPKYLKAGGMCKNILPFTVVPESLRHEFNAVVSKKDLYETYLPAFKALVQEAKVESVMGAYNRTNGEPCCGSKTLLSDILRGEWGFKGHVVSDCWAIRDFHMHHHVTATAPESAALAVRNGCDLNCGNMFGNLLIALKEGLITEEEIDRAVTRLMITRMKLGMFDPEDQVPYASISSFVDCKEHRELALDVAKKSIVLLKNDGLLPLDRKKIRSIAVIGPNADSRQALIGNYEGTASEYVTVLDGIREMAGDDVRIYYSVGCHLYKDRVENLGEPGDRIAEAVTCAEHADVVIMCLGLDSTIEGEEMHESNIYGSGDKPDLNLPGQQQELLEAVYATGKPIVLVLLTGSALAVTWADEHIPAILNAWYPGALGGRAIASVLFGETNPSGKLPVTFYRTTEELPDFTDYSMENRTYRFMKNEALYPFGFGLSYTTFDYSDLKLSKDTIRAGEGFNVSVKVTNTGKMAGEEVVQVYIKDLEASWRVPNWQLSGMKRVRLESGETAEITFEIRPEQLAVVTDEGKSVIEPGEFEIYVGGSQPDARSVRLMGKAPLKAVLRVQ

SEQ ID NO: 16678 - protein, 478 aa, Pseudomonas fluorescens PfO-1
MNNSYDQLYLFIGGEWIDAQGRSTAAVVNPATGREIGRVPLATAGDLDRALEVSRVGFEQWRQTVPDQRAKILKRAADLILERAPHIAAQMTLEEGKPLSESMDEVVRAAEYFEWFAESARRIDGRVVPANRPGVLQLVKRQAIGPVAAFTPWNFPAITPARKLSAALAAGCSVILKPGEESPSTALALARALDDAGLPKGVLQVVFGVPDQVSSQLIASAIIRKVTFTGSVPIGRLLSARAAEGVKPITLELGGHGPVLVFADADVEKAAVEGVANRFRGTGQVCISSTRFIVQRGAYQAFVDHFVTATKALKIGDGFDPQTQVGPLANPRQLVKMEQLIADAVEKGARVLVGGEALPGDGFFFQPTVLADVPMNARIMHEEPFGPIAVLMPFDELADGLQEANRLPYGLSAYAFTSNARTAIDVADGLEAGMIGINQYRIVATELPFGGMKESGHGSEGGVEGIEHYLTHKFISQV

SEQ ID NO: 16679 - protein, 924 aa, Medicago truncatula
MELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 16680 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 16681 - protein, 269 aa, Moraxella sp.
MQAWVIGNWKQNPATSHDVNALLDDLCAAISTTKQMSHDNSARCQIMVAPSLIHLAAVNGRLKDTSILCAAQDVSGHSASVGAYTGECSAQQIVDAGATWTILGHSERRQYHQESNDALLQKMIHALSQDLGVVFCIGESQEQYDTKQTLTVIDNQLVVIKEFITQQPELIDALPTRLIIAYEPVWAIGTGKVPTVAEVSATHKHIKQTLAGFADSLSNMTVLYGGSVNADNANSFAADPMIDGALVGGASLKADSFLTIATAFSQASI

SEQ ID NO: 16682 - protein, 518 aa, Oryza sativa; identical to SEQ ID NO: 2255

SEQ ID NO: 16683 - protein, 169 aa, Triticum aestivum
  unsure (1)..(169): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASXPGYYDGRYWTMWKLPMFGCTXDATQVINXVEXVKKEYLTLFAYRIDTCSSCVTHRKHGLQDPQG

SEQ ID NO: 16684 - protein, 360 aa, Zea mays
MDQNFGNLGTGAGSSGGCGGSNSNSKAVAAVSSSSFLQLPLSTAAAASPAYYGAPLALLHHGTTAGPSSSQQQQHQSPYAKHGAEMSAAEADAIKAKIVAHPQYSALLAAYLDCQKVGAPPDLLERLTAMAAKLDARPPGRHGPRDPELDQFMEAYCNMLVKYREELTRPIDEAMEFLKRVEAQLDSIAGGGSSSSARLSLADGKSSEGAGSSEDDDMDPSGRENEPPEIDPRAEDKELKYQLLKKYSGYLSSLRQEFSKKKKKGKLPKEARQKLLHWWELHYKWPYPSETEKIALAEATGLDQKQINNWFINQRKRHWKPSEDMPFVMMEGFHPQTAAALYLDGGAFMADGMTTYRLGS

SEQ ID NO: 16685 - protein, 200 aa, Burkholderia fungorum
MLLMIDNYDSFTYNLVQYFGELGEDVRTYRNDEITLDEIAKLNPERICLSPGPSNPQHAGITLDVLREFSGKTPILGVCLGHQAIGEAFGGRVVRAQTIMHGKVSTIETDCKGVFADLPKHFVVTRYHSLAIERESLPDCLEVSAWTEDGEIMGVRHKELAVEGVQFHPESILSEHGHALLENFLKQSKRAGAQTSNRNA

SEQ ID NO: 16686 - protein, 387 aa, Zea mays
MADQANQPTVLHKLGGQFHLSSTFSEGVRARNICPSVSSYERRFATRNYMTQGLWGPSMSVSGGINVPVMQTPLCANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 16687 - protein, 472 aa, Selenomonas ruminantium
MKIKAQISMVMNLDKCIGCHTCSITCKNVWTNRQGAEYMYFNNVETKPGIGYPKHWENQEKWKGGWELKNGRLQLRSGNKATRLAKLFYHPDQPEMDDYYEPWTYDYETLITSQRKNHQPIARPRSLITQKRMEIKWGPNWEDDLAAGESARQDYNLQNIAEDITLEFHDLFMKYLPRTCNHCLNPACVAACPSGAIYKRDEDGVVLVSQDGCRGWRHCVPACPYKKVYFNWKTNKAEKCIFCFPRLENGLPTVCADSCVGRLRYMGVLLYDMDKVKEAASTPDKGEIYHSMLDIILNPHDPEVIAAAKDAGIPANWLEAAQNSPVYKMVKEWQVALPLHVEYRTLPMVWYVPPLSPITQRAEADVYLPAVQEMRIPLSYIAELFAAGNVGVVEKVLQRLLDMRMVMRTQETGEKLSRKLEYELETYQAMYRLMGIAKYKDRFNIPAGLTGESQDKLRELQGSCGYNCPGGC

SEQ ID NO: 16688 - protein, 91 aa, Clostridium thermocellum
MIENILIIDNYDSFTYNLYQYVGEISPNIEVYRNDKITLEKIEEMNPTHIIISPGPGFPKDAGICIEAIRKFGRYIPILGVCLGHQAIGEA

SEQ ID NO: 16689 - protein, 550 aa, Agrobacterium tumefaciens str. C58 (Cereon)
MEVPLLFPRTRHLMSVQAGLGTHMDGTHLFELVIAMFLAIIVLHYIAHRLGLPPSVALLAGGGTLAFVPGLPTISVNPELVLVIFLPPLLLDGAWSISVDRLKRHVFGIASLAIGAVLFTTVIVAVVVHFLMPSLPWAACAALGAIVSPPDAVSARAVLERIRIPRRLQILLEGESLLNDASGLVLFRFAVAAAAGGVFSTVDALGEFFFLAVGGAAVGAFVGLLWVKTVRHLGDEYLMIAATAVLSWAAYILAEQAQTSGVIATVTAGLIASWHQHTVLSAATRMRGTSFWNVLVFLMEAMVFILIGLSLRDVVERGGGFGSIASSMALPALAVLVTLVAARFVWIFASDLVIRLFHGLKLAHSKPLGPGAVTALGWAGMRGVVTLALALSLPEDFPGRDFILVMAFAVIMGTVLIQGTTLGRIIAWAGLGGIEPERAPMTMSEAEASMAQVQFTTVQGLAYDENGELIHPQLLKRYEHRLAASVKYAESTEKYSPLLHAHFDVVLKAVAAGRKELIRLRREGQIDDETLRELEHDLDLEELTAISAKA

SEQ ID NO: 16690 - protein, 226 aa, Clostridium beijerinckii
MKLIIDDVNIEKIKDVFSIFQIDGVTSNPSILHKYGKQPYEILIKIREFIGENSELHVQVISESSEGMLKEAHKIIKELGKNTYVKIPVTRDGLKAIKILRKEEINVTATAIYTQMQAYLAGKAGAQYAAPYVNRIDNLGANGVQVAKDIHDIFEKNNFKTEVLAASFKNSQQVLELCKYGIGAATISPDVIEGLIKNDCVDVAVENFKKDFEILCGQGNTMLNCR

SEQ ID NO: 16691 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGGVNVLATIVSIYGVDKWGRRFLFLEGGTQMLICQVIVATCIGVKFGVDGEPGALPKWYAIVVVLFICVYVSGFAWSWGPLGWLVPSEIFPLEIRSAAQSVNVSVNMFFTFIIAQIFLNMLCHMKFGLFLFFAFFVVVMSFFIYFFLPETKGIPIEEMAEVWKSHWFWSRYVNDGSYSGVELVKENYPVKNV

SEQ ID NO: 16692 - protein, 470 aa, Triticum aestivum
MSVPVAYQGNTSAAVADWLNKGDNAWQLTASTLVGLMSVPGMVVLYGGVVKKKWAVNSAFMALYAFAAVWICWVVWAYNMSFGEELLPFWGKAGPALDQAFLVGRASLPATAHYRADGTLETAMVEPYFPMATVVYFQCVFAAITLILVAGSLLGRMSFLAWMLFVPLWLTFSYTVGAFSVWGGGFLFHWGVIDYCGGYVIHIPAGVAGFTAAYWVGPRTKKDRESFPPNNILFALTGAGLLWMGWAGFNGGGPYAANVDSSMAILNTNICTAASLIVWTCLDAVFFKKPSVVGAVQAVITGLVCITPGAGVVQGWAALVMGVLAGSVPWYTMMVLHKRSKLLQRVDDTLGVIHTHGVAGLLGGVLTGLFAEPNLCNLFLPVTNSRGAFYGGNGGAQLGKQIAGALFVIGWNVVVTSIICVVIRLVVPLRMSEEKLAIGDDAVHGEEAYALWGDGEHYDDTKHGAAVVPV

SEQ ID NO: 16693 - protein, 339 aa, uncultured cyanobacterium
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 16694 - protein, 261 aa, Emericella nidulans
MGHEDAVYLAKLAEQAERYEEMVENMKVVAASDVELTVEERNLLSVAYKNVIGARRASWRIVTSIEQKEESKGNKSQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 16695 - protein, 497 aa, Ferroplasma acidarmanus
METYKMFIGGEWVESSENQVLKVLNPSTGLPVASVQSASRDDVGKAIDAARNSFDSGIWSRATPGDRSNVLLKVADLIEKNQDKFIKVETENSGKSIKQISGYDIPYTVDNIRFLAGACRTLEGKAMNEYVADGTSAIRREPIGAIGIITPWNYPLMMVVWRAFPALAMGNSVVVKPASYTPLTTLMLADILKEAGVPDGVFNVITGPGSSVGEEMAKSEKLDMIAFTGSTEVGKRLSVLAASNLKKVSLELGGKAPFIVFKDANIDAAVESAIVGGLVNNGQDCANSTRYYIQEEVFDKFVSLLKKRIQKLRIGDPMDPSTDMGPLISETQRERVEGYIEKGIKEGGKLLSGGERPEIPGHKKGYYINPALIYTENEDSAIVKEEIFGPVFTILKFKDYNDAIRRSNDVTYGLGSSVWTSDITTAMRATRDLRFGTVWVNEHVVVPSEMPWAGYKESGHGASLSPYSLEEFTYIKHVYFDLTGKVRKDWYDQIFKG

SEQ ID NO: 16696 - protein, 334 aa, Escherichia coli CFT073
MWIKVAAAEQHILVYQYNKEFRMKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 16697 - protein, 304 aa, Burkholderia fungorum
MAANAAGVLARQDRPQSQQRREGARGAARERLARRRGVGMRFAWRQSRYRGCPGPARRVAEQRRAELRGARLKAACSPLRCRREEAARKRPGSGPKPAGDTLDWLTRGISARRAALQHKRTTARPDHPRTTQEGRHIMAEFRLWSDEFPTNGFMPKAHEYHDKAFGVDGENISPALKWEAPPPDTQSFALTVHDPDAPTGSGFWHWVVVNIPADIRSLPRNAGKPDGSLLPHGALQLRNDYGTVGFGGAAPPRGDKAHRYIFRLHALRVPHLPINADTTNAVARFMTHLNELDSTTHTGLYELK

SEQ ID NO: 16698 - protein, 401 aa, Enterococcus faecium
GALAGRSFSASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALASILKARGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKNK

SEQ ID NO: 16699 - protein, 407 aa, Zea mays
MAAALQATPLKTLSISRRRVGGAGARPRPMAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYSASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 16700 - protein, 170 aa, Staphylococcus carnosus
MTKNEHVNVKLDRDIQCAVLTVSDTRTPETDKGGNLAKELLSEINVEIKPEHYAIVKDDKQAITEQLQQWLAEDVDVIITTGGTGIAQRDVTIEAVTPLLSKEIEGFGELFRYLSYAEDVGTRALLSRAVAGTVGEQLIFSVPGSTGAVKLAMNKLIKPELNHLIHELTK

SEQ ID NO: 16701 - protein, 490 aa, Lycopersicon esculentum
MMTTQNRRSSAVAKRQAMAANSSGLEHNQTGKLNAKKRPALSNISNNTTVSARNSVSHSSKLAPCTSKIVNIKKNTSACNSNAVSSGTAVLPASSSVRPSSKPVSIQRSDAVVPKITVIPVPATCSMDISPSHSDGSLVSMDESMSNSDTVRSPEVEYIDDHELAAVDSIEKKACSTLYISEHVKAAAADICKRDVLVDLESGDKIMNIDNNLVDPQLCATMACDIYKHLRASEAKKRPSTDFMAKVQKDINPSMRAILIDWLVEVAEEYRLVPDTLHLTINYIDRYLSGNLMDRQRLQLLGVACMMIASKYEEICAPQVEEFCYITDNTYFKEEVLQMESAVLNYLKFEMTAPTAKCFLRRFVRAAQGLNEVLSLQLEHLASYIAELSLLEYNMLCYAPSLIAASAIFLAKYILLPSVKPWNSTLRHYTLYQPSDLRDCVLALHSLCCNNNNSSLPAVREKYSQHKYKFVAKKYCPPTVPVEFFQNISS

SEQ ID NO: 16702 - protein, 231 aa, Staphylococcus aureus subsp. aureus MW2
MTVLTDKIAVVTGAGSGIGEAIATLLHEEGAKVVLAGRNKEKLQNVANQLSQDSVKVVPTDVTNKEEVDELIKIAQQTFGGLDIVINSAGQMLSSKITDYQVDEWDSMIDVNIKGTLYTVQAALPTMLEQSSGHLINIASISGFEVTKSSTIYSATKAAVHTITQGLEKELAKTGVKVTSISPGMVDTAITAAYNPSDRKKLDPQDIAEAVLYALTQPSHVNVNEITVRPV

SEQ ID NO: 16703 - protein, 496 aa, Botryotinia fuckeliana
AQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTALHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASL

SEQ ID NO: 16704 - protein, 426 aa, Aquifex aeolicus VF5 [sequence omitted]

SEQ ID NO: 16705 - protein, 518 aa, Oryza sativa; identical to SEQ ID NO: 14650

SEQ ID NO: 16706 - protein, 326 aa, Escherichia coli
  unsure (1)..(326): unsure at all Xaa locations
LPNITILATGGXIAGGGDSATKSNYTVGKVGVENLVNAVPQLKDIANVKGEQVVNIGSQDMNDNVWLTLAKKINTDCDKTDGFVITHGVDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 16707 - protein, 666 aa, Zea mays
  unsure (1)..(666): unsure at all Xaa locations
HLNAKICHGLAHLNAKKICHILYPGDESLEGKVLRLKQQYTLCSASLQDIIARFESRAGESLNWEDFPSKVAVQMNDTHPTLCIPELMRILMDVKGLSWSEAWSITERTVAYTNHTVLPEALEKWSLDIMQKLLPRHVEIIETIDEELINNIVSKYGTTDTELLKKKLKEMRILDNVDLPASISQLFVKPKDKKESPAKSKQKLLVKSLETIVDVEEKTELEEEAEVLSEIEEEKLESEEVEAEEESSEDELDPFVKSDPKLPRVVRMANLCVVGGHSVNGVAEIHSEIVKQDVFNSFYEMWPTKFQNKTNGVTPRRWIRFCNPALSALISKWIGSDDWVLNTDKLAELKKFADNEDLHSEWRAAKKANKMKVVSLIREKTGYIVSPDAMFDVQVKRIHEYKRQLLNILGIVYRYKKMKEMSTEERAKSFVPRVCIFGGKAFATYIQAKRIVKFITDVAATVNHDSDIGDLLKVVFVPDYNVSVAEALIPASELSQHISTAGMEASGTSNMKFAMNGCILIGTLDGANVEIREEVGEENFFLFGSXAHGLGGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 16708 - protein, 225 aa, Zea mays
WKMLLALPAAWASNFFYTYQFNNVNSGLFTLRTRGLNNVFYWGAQMIGSAGIGYFLDFGFASRRKRGLFGVAAVAAVGTAIWGGGLANQLSYNAVPVPDPIDFKDGHRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSMEDGREKDSKLSAPTSFH

SEQ ID NO: 16709 - protein, 357 aa, Pyrobaculum aerophilum str. IM2
MAECGIILAGGFATRLRPLSYTKPKPLFPILGRPVIDWVIEKVSEVAEPVISARYLSYIIRNHVNAKWGGRVRVVEEDRPLGDGGAVVNVIKSLGLRGPVIVANGDVFTDISIREMWDFHKKMGGAVTIALIEVPPEEIGRFGIAVLEGERVKRFVEKPKEPVGSNLANAGIYIFEPEAIAQFPDINSGELKIAKHIIPKLMQKFDIYGYVHRGLWFDIGTHGDYLKANFAALERCNCHREVPGVKIIPPVYIGEGAVVGPGSVLGPYVVIGNGSRLGPNVRIRESVLMDGVVAEAGAYVAKSIIGEGVVLGKWTRVIEAVVADGVYIRDEVLVGRGASIGPNREVEQDVKEGEILP

SEQ ID NO: 16710 - protein, 222 aa, Setaria italica
IENKISRQVTFAERRNGLLKKAYELSLLCDAEVALIIFSGRGRLFEFSSSSCMYKTLERYRSSNYGSQEIKTPLDGEINYQDYLKLKTRVEFLQTTQRNILGEDLGPLSMKELEQLENQIEIFLKHIRTRKNQMLLDQLFDLKSKEQELQDLNKDLRKKLQETNAESVLHVSWEEGGHSGTSGNAIEPYQGFLQHPDNDPSLQIGYHQQAYMDQLNNEDMGD

SEQ ID NO: 16711 - protein, 436 aa, Glycine max
  unsure (1)..(436): unsure at all Xaa locations
MTVFTEVRREKEKRVQICLTKTSYKHIQIRQKNKRVKRTNRAMEGGGAAPPADTVMSDXGATAAAAPMAMGIENIPATLSHGGRFIQYNIFGNIFEVTAKYKPPIMPIGKGAYGIVCSALNSETNEHVAIKKIANAFDNKIDAKRTLREIKLLRHMDHENVVAIRDIVPPPQREIFNDVYIAYELMDTDLHQIIRSNQALSEEHCQYFLYQILRGLKYIHSANVLHRDLKPSNLLLNANCDLKICDFGLARVTSETDFMTEYVXXRWYXAPELLLNSSDYTAAXIDVWSVGCIFMELMDRKPLFPGRDHVHQYILLTLQLIGTPSEADLGFLNENAKRYIRQLPLYRRQSFQEKFPHVHPEAIDLVEKMLTFDPRKRITVEDALAHPYLTSLHDISDEPVCLTPFSFDFEQHALTEEQMKELIYREALAFNLEYQQ

SEQ ID NO: 16712 - protein, 318 aa, ASPERGILLUS NIDULANS FGSC A4
MPPRQRRPTEIHKKDPGGCQTASVATAVLEDPPRAIRSLVHWDELPHWQRDNQHIHTGYRPASYSFRGSFQSLTYIHNETVNIYTHLLPSVLAIPAAIQLYRALAPRYETATDGDIRAFGCFFVGAAFCLGMSAFYHTISNHSPTVARIGNTFDYIGIVGLIVGSFVPSVYYGFYCVPELQRLYWSMICTIGLGCIVVSIFPKFRTPRWRPFRAAMFVGMGLSAVFPVVHGLQLYGRDQMMRQIGLGWLLLQGFLYILGAGIYAARVPERLRPGGFDLWGSSHQIFHVLVVCAAVAHLTGLLRAFDYRHNGTAGSCQV

SEQ ID NO: 16713 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 16714 - protein, 495 aa, Geobacter metallireducens
MKVRAQVSMVFNLDKCIGCHTCSIACKNIWSDRRGAEYMWWNNVETKPGTGYPTLWEDQEKYRGGWERTDREPRLRLHSRGGGLAKLFFNPRLPTIDDYYEPWSYRYGDLLSAPAGDDQPVARPVSLVTGDPINIEAGPNWDDDLGGSPVYGAHDPNLAAVSEAERRQLFLLERMVLFYLPRICNHCANPGCVAACPSGAIYKRGEDGIVLVSQEKCRGWRMCVSGCPYKKVYYNWGSGKSEKCILCYPRQETGQAPACFHSCVGRLRYLGVLLYDAERIERSASRPDHDLVQAQREMILDPSDPEVVNKAAEEGIHPAVLAAARNSPVYRFVKEWRLALPLHPEFGTVPMLYYVPPLLPLAADRENGCYDLGGEFFTSLEQGRLPLRYLASLFSAGNEEIIRAVYRKLTAVRVHRRAATTGDVPAGELERFLAEAGTTPEEAEAIYHMTSLAGFDERHAVPPFMREMAMEMSVDPADRKGEAGTGFLRPPKRGW

SEQ ID NO: 16715 - protein, 315 aa, Desulfitobacterium hafniense
PLSDNQNSLRASERGPTLLEDFILREKITHFDHERIPERIVHARGSAAHGYFELTRSLKKHTTAQVLTEVGERTPVFVRFSTVAGGAGSIDTPRDVRGFAVKFYTQQGNWDLVGNNIPVFFIQDAMKFPDLVHSVKMEPDRGFPQAASAHDTFWDFISLTPEAMHMIMWAMSDRAIPRSLRMIEGFGVHSFRLLDAKGRSTFVKFHWRPKLGLQSTLWDEAVKLAGADPDFHRRDLFEAIERGDYPEWELAVQLFDQEQADALPFDHLDPTKLIPEETIPLTVIGRMVLDRWPDNFFAETEQVAFCPSHVVRLAS

SEQ ID NO: 16716 - protein, 472 aa, Mazzaella sp.
  unsure (1)..(472): unsure at all Xaa locations
ESVVIPYAKMGYWDPDYVVKDTDVLALFRVSPQPGVDPVEASAAVAGESSTATWTVVWTDLLTACDLYRAKAYKVDTVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERFLYSMEGVNRAIAAAGETKGHYLNVTAATMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALESXXXXRNEGRDYVTEGPQILQDAAKTCGPLQTALDLWKDITFNYTSTDTADFVETPTANV

SEQ ID NO: 16717 - protein, 511 aa, Glycine max
LHWPFVLVSISKSTTTPSLLFSIIIISTPFTLSHSSLESSTAMATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 16718 - protein, 473 aa, Nicotiana tabacum
MASRIVLQQQNRGEAVPGAVKQKKNMAPEGRNRKALGDIGNVATGRGLEGKKPLPQKPVAVKVKGANVAKVPAARKPAQKKATVKPNPEDIIEISPDTQEKLKEKMQRKKADKDSLKQKATLTSTLTARSKAACGLSKKPKEQVVDIDAADVNNELAVVEYVEDIYSFYKLAENETRVHDYMDSQPEINDRMRAVLIDWLVEVHQKFELNPETLYLTINIVDRYLAVKTTSRRELQLLGISAMLIASKYEEIWAPEVNDFVCISDKSYTHDQVLAMEKEILGQLEWYLTVPTPYVFLARFIKASLPDSEIENMVYFLAELGLMNYATIIYCPSMIAASAVYAARHTLNRTPFWNETLKLHTGFSESQLIECARLLVSYQSAAATHKLKVIYKKYSSPERGVVSLLTPAKSLLAASSSSVLSEQADLRKSTEAAATSSSKMVVVGCQRCHMYVMVTEADPRCPQCKSTTTRKMT

SEQ ID NO: 16719 - protein, 253 aa, Zea mays; identical to SEQ ID NO: 3990

SEQ ID NO: 16720 - protein, 525 aa, Oryza sativa
LTGAASAALSVAAAARRRVAAGRTDSDDAAAAPPGESPALRARFHGFLRAFLLLSVLLLAVDVAAHAQGWHAVVPDLLAVEGLFAAAYASWLRVRLEYLAPGLQFLANACVVLFLIQSADRLILCLGCLWIKLKGIKPVPKASGGGGGGKGSDDVEAGADEFPMVLVQIPMCNEKEVYQQSIGAVCNLDWPRSNFLVQVLDDSDDAATSALIKEEVEKWQREGVRILYRHRVIRDGYKAGNLKSAMNCSYVKDYEFVVIFDADFQPQADFLKRTVPHFKGNEDVGLVQARWSFVNKDENLLTRLQNINLCFHFEVEQQVNGVFLNFFGFNGTAGVWRIKALEDSGGWMERTTVEDMDIAVRAHLKGWKFLYINDVECQCELPESYEAYRKQQHRWHSGPMQLFRLCFVDIIKSKLGSAYEWVVTKKSGRSSEGDLVSLVEKQPKQQRVGSAPNLDSLAKESHPKKDSKKKKHNRIYQKELALSFLLLTAAARSLLSVQGIHFYFLLFQGVSFLVVGLDLIGEQVE

SEQ ID NO: 16721 - protein, 348 aa, Trichodesmium erythraeum IMS101
  unsure (1)..(348): unsure at all Xaa locations
MTAVNTQKLDVYGVGNALVDILALVEEDFITKFSLQKSGMTLMDAQKQGGILAGLKDISLKKRSGGSAANSMIALAQSGGTGIFVAKVASDPNGELYRQDMLNFKMDFNVPPAPTADNPTGTCVVLTTPDAERTMCTNLGVSVNLSVSDIDVEQIKRCKYSYVEGYLWTGDSTKEACKQAMQYSKDEKVKVCFTFSDQFLVDMFADEFRSLLLDYCDVLFCNADEARSFCKKDSLDDSAKSIGELVETAFITNGKEGCLVVKDKQITSVPGFNATAIDTVGAGDAFXXXXXXXXXXXXXXXXXYGLTHGYEPTQAARWGNYLASNVVQIQGPRLEGSWADKVQQIINA

SEQ ID NO: 16722 - protein, 247 aa, Ipomoea nil
MGRGRVQLKRIENKINRQVTFSKRRTGLLKKAHEISVLCDAEVALIVFSTKGKLFEYATESCMEKILERYERYSYAERQLNSTDQNSQGSWTLEHAKLKARMEVLQRNQRHYEGEDLDSLSLKELQNLERNLIQHSNIRSKRNQLMYESILCSEKDKHCRTKYQLSKKIKEREKEMATQQQQQQEVQWEQPNDDINSSYVVPPPLVHLSSEGEYQGEGEYGETEGTQRQQQNNTSAMPQWMLSHLQG

SEQ ID NO: 16723 - protein, 394 aa, Zea mays subsp. mays
LGAERRARLPPGQMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNCGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 16724 - protein, 486 aa, Pseudomonas putida
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQGSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 16725 - protein, 566 aa, Cladosporium fulvum
MAPSATAHSADGRTTGDIHRDYNDDRNASAEDTVYCTSNGVPIAHPYEAQRVGDNGPLLLQDFHLVDLLSHFDRERIPERVVHAKGGGAHGYYQTTDPLDDLCLADIFQAGKKCPISVRFSTVGGESGSHDCARDPRGFSVKFRTEEGNWDMVANNTPVFFLRDPAKFPHFIHTQKRDPQSHLTHADDSTMFWDYLSQNPESVHQVMILMGDRGIPDGWRKMHGYAGHTLKLVNKKGDWVYAQMHMKSKQGTDFITQEDSANYSPDYAQKDLYQAIEKGDYPGWDVEFQTMTPKEAEDLWETQKINVFDLTHVWPQKQFPRRKVGEFFLNENVKNYFAEIEQIAFNPAHMPPGIEPSADPVLQSRLFSYPDTHRHRIGVNYQQLPVNAPRVPYRIANFQRDGAMAYLNQGSRPAYLSSIQPNQFRKRTVNLDKTHGHFVGDAVTFLSEIRPEDFNAPRALWERVWDDGARERFINNVSGHMSNCTKEEIIKRQIAIFREVSNDLATRLEKATGVEGYDGIAGLSFNGEHNGMAKDASLRAANNMVDKQSMAANNGAPAAGTHVKVN

SEQ ID NO: 16726 - protein, 367 aa, Oryza sativa; identical to SEQ ID NO: 6832

SEQ ID NO: 16727 - protein, 194 aa, Glycine max; identical to SEQ ID NO: 2198

SEQ ID NO: 16728 - protein, 166 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQVIYRTVIC

SEQ ID NO: 16729 - protein, 151 aa, Desulfitobacterium dehalogenans
MISSSALLIVVVFFALAFDYINGFHDTANAIATSVSTRALTPKRAIIIAAILNFVGALVSTGVAQTIAKDIVNPEFVTQEIVIAALIGAIFWNLATWYFGIPSSSSHAIIGGMIGAAVSKVGFGVLQVQGIMKIVAALLISPIFGIILGFI

SEQ ID NO: 16730 - protein, 429 aa, ASPERGILLUS NIDULANS FGSC A4
MESISPVYSAATKSDKRYSPPWADLSIIGIAGSSGSGKTSVAMEIVKSLDLPWVVILVMDSFYKSLNPEQHAKAHRNEFDFDSPDSIDFDVLVQCLRDLKQGIVELLDVKAVELSDGSQIVLRDVKERGRDIDGIIKQWFNYVKPSYKKFVEPQRSVSDIIIPRGIENKTAIGMVVQHIQRMLEEKSERHSATLQELRRITFEEQLSQNVIMMPQTPQSIGMNTILQNPETEQVDFVFYFDRLAALLIEKYILISDSSHSHGMADSRYRALDYTSYAPKEVETPQHNMYSGLKQEGIVSAVAILRGGSCLETALKRTIPDCVTGRVLIRTNETKEEPQLHYLKLPPGIEQHSNVMLLDSQMSSGGAALMAVRVLIDHGVPEDRIIFVTCAAVQSGVKRLAAVYPHVKLIVGRIEEESEPRWMEHRYFGC

SEQ ID NO: 16731 - protein, 162 aa, Zea mays
  unsure (1)..(162): unsure at all Xaa locations
TSRGSRSTRTHNXAVDIXXDLXRSEKLLGDLGGLSDAWADAWADAWVRGPMLTRDDSFIRKGSHLEQRQKLGLADHPPPSNARQFRSEPSSALEKVEIEKAKQDDDLSDLSNILTELKGMAVDMGSEIERQTKAMGDAEKDYDELNFRVKGANTRARRLLGR

SEQ ID NO: 16732 - protein, 195 aa, Rhodobacter sphaeroides
MLLLIDNYDSFTYNLVHYLGELGAEVVVRRNDALDVQAAMGMHPDAIVLSPGPCDPAAAGICLPLTAAAAEARIPLLGVCLGHQTIGQAFGGKVVRCHEIVHGKMGAMHHEGKGVFAGLPSPFLATRYHSLVVERDSLPDCLEVTAWLEDGTIMGLRHKSLPIEGVQFHPESIASEHGHQMLRTFLDSARAAVTA

SEQ ID NO: 16733 - protein, 472 aa, Thermobifida fusca
MITTDRIYIDGQWIAPQTSDRMAVENPYTCQDIATIPLCGTEEVDHAVHAARRAFPAWSTTDLEERLAHLDALRRELAVRATEMSALITSEMGAPKVIADRIQVGLPLTVLGDTVATARDFAWTEKIGNSLILREPIGVVGAITPWNYPLHQIVAKIAPALAAGCTVVLKPSEIAPLSALLLAEIIDSVGFPPGVFNLVTGTGPVVGEALAAHPDVDMISFTGSTRAGSRVSEVASATVKKVALELGGKSAGVVLDDADLPTAVKAVVSDCLLNSGQTCTALTRLLVPHDRYEEAVALAVDAARSKPMGDPADPATRIGPLASADAHRRVLGHLEQARKDGAVFATGGPDADVPEQGYFVAPTVLAGLDRDAAAAREEIFGPVLTVLGYRDVDDAVELANATDYGLSGAVWSADTDRALAVARRMRTGQVAINGGRFNPSAPFGGYRKSGNGRELGRFGLEEFCEVKAVQLP

SEQ ID NO: 16734 - protein, 128 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQ

SEQ ID NO: 16735 - protein, 400 aa, Haloarcula marismortui [sequence omitted]

SEQ ID NO: 16736 - protein, 483 aa, Pseudomonas stutzeri
MNTKLFINNVWVNSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQRVQEAGLPAGVLNYLNSSPDRSPEIADALISAKEIRRINFTGSTRVGSIIAQKAAQHLKRCLLELGGKSPLIVLDDADIDAAVKAAVFGSFLVQGQICMSTERLVVDEKIADEFAAKFAEKAKRLSAGDPCVTGDCIIGPMVSPNSGERINGLFKDAIDKGATVACGGMAQGAVMPATILDHVKSNMRIYDEETFGPITVVIRCSGEAEAIRIASDSAYGLSSGVFGRDINRALRVGMSIEYGSVHINGSTVQSEAQAPYGGTKNTGYGRFDGRAVIDEFTELKWLTIEPFEQQYPF

SEQ ID NO: 16737 - protein, 369 aa, Chlorobium tepidum TLS
MNHDHLLAHRHGDRSGDRLASAISLDFSVNLAPIEPPLQELFSTSIPLAPYPSMDGHGVREFYAARFGLDPVCVLSTNGAIEGLYLIPRALGIKRVLVPQPSFFDYGRACRLAGAEVVPLALSESGSFAFPGIDKLADALAGCDALLAGSPNNPTGTLIPKELLLALACRFPEKRFIVDEAFIQFTEAFPSNSLMTEIKAFRNIAVVHSLTKFYAIAGLRLGAVIAHPSMIRQLYGYKEPWTVNAVAEHVAGQLLHCGEYEREVHAIVREGRKQIADGLAGNSVITLHGGAANFFFASVADEFSLDALFDVLAERGILVRDCRNFEGVPPKYFRFCIRTSDENRRLIEALNDFAELSRIAKAAVEEAVS

SEQ ID NO: 16738 - protein, 333 aa, Streptomyces arenae
MTVRIGINGFGRIGRNVFRAAAARSSELEIVAVNDLGDVPTMAHLLAYDSILGRFPEEVTAEPGAIRVGDRTIKVLAERDPGALPWGDLGVDIVIESTGIFTDAAKARSHVDGGAKKVIIAAPASGEDFTVVLGVNDGDYDPERHTIISNASCTTNCLGVLAKVLHDAVGIDSGMMTTVHAYTQDQNLQDAPHKDLRRARAAALNIVPTSSGAAKAIGLVLPELAGRLDAFALRVPVPTGSVTDLTVTTRRGTSVEEVKEAYAAAASGPYKGLLSYVDAPLVSTDIVGDPASLFDAGLTRVCGPQVKVVGWYDNEWGYSNRLIDLATLIGSSL

SEQ ID NO: 16739 - protein, 765 aa, Neurospora crassa
MQRLALHYPPLDPAAEPPTEHILQQSNPTMSNIISQAGQKAKEALTSAPSSKKVDDLKNEFKETDKSARLTTDYGVKQTTADDWLRIVSDDKIGPSLLEDPFARERIMRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 16740 - protein, 356 aa, Escherichia coli O157:H7 EDL933
MSTVTITDLARENVRNLTPYQSARRLGGNGDVWLNANEYPTAVEFQLTQQTLNRYPECQPKAVIENYAQYAGVKPEQVLVSRGADEGIELLIRAFCEPGKDAILYCPPTYGMYSVSAETIGVECRTVPTLENWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIIAMRERVAQIIAEREYLIAALKEIPCVEQVFDSETNYILARFKASSAVFKSLWDQGIILRDQNKQPSLSGCLRITVGTREESQRVIDALRAEQV

SEQ ID NO: 16741 - protein, 419 aa, Clostridium tetani E88
MNYSILDYLFIYSLASIWVLLLMNIILSLSGYSYYKCAEKIKLSKMPSNDYPFVSIIVPAHNEEKVIEKTVKSLLLLDYPKNKMEIIVVNDNSQDNTATLLENLKREYDMDNLKIINTDNITGGKGKFNALNIGFNHSVGELIAIYDADNTPNKLALKYLVQTIKKDENLGAVIGKFRTRNKERNLLTKFINIETLSFQWMAQAGRWQLFNLCTIPGTNFIIRRDIIKEIGGWDIKAIAEDTEISFRIYKLGYKIKFMPLAVTWEQEPESLKVWFKQRTRWVKGNIYVLLKHMKNIGNKEDKSILFDIVYFFTVYFLFLSSVIISDLIFITSLFSDLQINVLGNFLVLWILAYLLFILEVGLTLTLEKGESNFKNIALIPIMYFTYCQMWMIVSIKGMFQYFFDNLFKREVKWYKTERF

SEQ ID NO: 16742 - protein, 289 aa, Dechloromonas sp. RCB
MKKVRKAVFPVAGMGTRFLPATKASPKEMLPIVDKPLIQFAVEEAVAAGITDMVFVTGRSKRSIEDHFDKAYELESELQARGKDELLDFVRNMIPKNINCIYIRQAEALGLGHAVLCAKPVIGDEPFAVILADDLLDGKPAVMKQMTDTYDYYRCSVLGVQDVPRADTRSYGIVDARPVAERVEQVNAIVEKPKPEDAPSTLAVVGRYILTPRIFHHLENVKPGAGGEIQLTDGIASLLSEEQVLAYRYHGTRYDCGSKLGYLQATVVFGQRHPEVGPAFDAYLKTLGG

SEQ ID NO: 16743 - protein, 175 aa, Oryza sativa
  unsure (1)..(175): unsure at all Xaa locations
IVDFFSHHPESLHMFSFLFDDVGIPLNYRHMEGFGVNTYTLINKDGKPHLVKFHWKPTCGVKCLLDDEAVTVGGTCHSHATKDLTDSIAENEQLAFCPAIIVPGIHYSDDKLLQTRIFXSYADTQRHRLGPNYXLMLPVNAPKCAYHNNHHDGXSMNFMHRDXEVNLLPXRFDAA

SEQ ID NO: 16744 - protein, 348 aa, Agrobacterium tumefaciens str. C58
MAIARGYAATDASKPLTPFTFERREPNDDDVVIDIKYAGICHSDIHTVRNEWHNAVYPIVPGHEIAGVVRAVGSKVTRFKVGDHVGVGCFVDSCVGCATRDVDNEQYMPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASLDA

SEQ ID NO: 16745 - protein, 558 aa, Photobacterium profundum
MYENNKTLYLPYAGPTLLENALLNKGSAFSPEERQNFSLMGLLPAAIESITEQEERAYSQYQTFNDDMDKHIYLRNIQDTNETLYYRLIDNHIEEMMPIIYTPTVGAACEQFSNIYRRGRGLFLGYPDKGNIVDILNNAARQDVKIIVITDGERILGLGDQGIGGMGIPIGKLALYTACGGINPANTLPIVLDVGTNNTQLLSDPMYMGWRHPRITGQEYDDFVEEFIQAVKSRWPNALIQFEDFAQKNAMPLLNRYKDKVCCFNDDIQGTAAVTVGSLLAACKAAGSELSEQRITFVGAGSAGCGIAEAIVAQMIAEGLSDSAARARIFMVDRWGLLTDNMQNLLDFQQKLAQKSATVSQWNETGNISLLDVVSNGKPTVLIGVPGLFSQEVIMEMHAHCKRPIVLPLSNPTSRVEATPSDIIRWTEGDALIATGSPFDPVIFNEKTYPIAQCNNSYIFPGIGLGVLASGATRVTDEMLMESSRVLAECSPLAQNGNGALLPPLKDIHQVSHCIALAVAKKAVEQNKAPQRTEKQLLEKIESYFWKPEYLKYKRTAL

SEQ ID NO: 16746 - protein, 375 aa, Arabidopsis thaliana
MPLSLQSPPCATLSASIQKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLASSMGPASV

SEQ ID NO: 16747 - protein, 389 aa, Zea mays
  unsure (1)..(389): unsure at all Xaa locations
MAVAAFPSCGAFAPPCLVSTRRAFSSVVAMASAAPVRAPSRKPFAPPREVHRPVAHSLPPQKREIFESLESWAADNILVLLKPVERSWQPQDYLPDAASESFDDEVRELRERAREIPDDYFVCFVGDMVTEEALPTYQTMLNTLDGGVRDETGASSTSWAVWTRAWAAEENRHGDLMNKYLFLTGRVDMRQIEKTVQYLIASGMDPKTETNPYMGFVYTSFQERATFISHGNTARHARRYGDTKLAQICGTIAAERARDEXTRIVEKLFEVDPDYTVRAFADTMRKKVAMPAHLMYDGQDDGLFARFTAVAQRIGVYTARDYVDILEFLVRRWGVQELTGLSGEGRRAQEFVCELGPRFRRLEERAHDNKAKDPEFAPFSWIHGRQVQL

SEQ ID NO: 16748 - protein, 71 aa, Glycine max
  unsure (1)..(71): unsure at all Xaa locations
LSLLLMVHPDDVVFGGXDISXLDLAHAMATARVFDIDLPPTPTPYIVSIDPLTAIYVPYCIAGNQGDRVNN

SEQ ID NO: 16749 - protein, 344 aa, Nostoc punctiforme
MVQERTLPTFNPATTQITKEEGLWLYEDMVLGRLFEDKCAEMYYRGKMFGFVHLYNGQEAVCTGVVQSMRPGEDYVCSTYRDHVHALSAGVPAREVMAELFGKATGCSKGRGGSMHMFSAEHRLLGGYAFVAEGIPVAAGAAFQSKYRREVLGDKNADQVTACFFGDGAANNGQFFETLNMAALWKLPILFVVENNKWAIGMSHERATSQPEIYKKASAFNMVGVEVDGMDVLAVRAVAQEAVARARAGEGPTLIEALTYRFRGHSLADPDEMRSKAEKEFWFARDPIKKLAAYLLEQNLANEGEIKAIDRKIQDVIDEAVKFAESSPEPDPSELYRFVFAEDE

SEQ ID NO: 16750 - protein, 199 aa, Triticum aestivum
AWSRPRYTVPVEERFVMKRIGPKNFHMFRCVTRYGYKDIQKKHDDFEKMLLDRLLIFVRLESMMDGYSDSEDFTMTEHKVERPANALLMSEKAGSDLSYSSHDSSIVLAKSPLTGNNSVTRYSSQTYGDELEFLNSCKDAGVVHILGNTIVCARRDSGIIKRIVVDHLYAFLRKVCREHSVIFNVPHESLLNVGQIYYI

SEQ ID NO: 16751 - protein, 689 aa, Oryza sativa (japonica cultivar-group)
MAASRLVAAAAIVVVVLVLAGAGAAGAAGAGEVRALLDLAAGLDPTGRLLPSWAPGRDPCGREGGGGFEGVACDGATGAVANVSLQGKGLAGTLPPAVAGLTALTGLYLHYNRLTGALPRELAALSRLTDLYLNVNNFSGPIPPEIAAMPSLQVVQLCYNQLTGGVPTQLGLLKRLTVLELQSNHLSGAIPASLGDLPQLVRLDLSFNNLFGSIPVRLALLPRLLALDVRNNTLTGSVPSELAKLQGGFQYANNTDLCGTGLPALRPCTPADLISPDMPQPFSAGISPQITPGSSSDGHGHCTGTHCPPSTKALAAVVVVAVILLAVTGAGMFALSWYRWRKQRVVAGSPAAVGGRCSTDAAGKDSFRKSASSTLVSLEYSNGWDPLADGRGGIGFSQEVAQSFRFNMEDVESATQYFSELNILGKNGNFAATYRGTLRDGTSVVVKRLGKTCCKQEEAEFLKGLKLLAELQHENIVGLRGFCCSRARGECFLVYDFVPNGSLSQFLDIDADDVARSNGRVLEWSTRISIIRGIAKGIEYLHSTRANKPPLVHQNISADKVLVDYTYRPLISGSGLHKLLVDDLVFSTLKASAAMGYLAPEYTTTGRFSEKSDVYAFGVIVFQILTGKSKIMQLPLESSNDEDLIDGNLRGCYSAAEAAKLAKIASACTSENPDHRPTMEELIQELCTF

SEQ ID NO: 16752 - protein, 232 aa, Zea mays
MASSSHSRRGRSARQAPFFRDLATPIPSHRGVSRFASGASPSAAPSATPPPPPIFTLDDLYASADFSPDPTASDLLPVASSPSPRAAASCSPPWDLSRGKVSLSAPGSPMDGVVEPARKEVLALPPPASPGTPPPATTAEAQSPVSPAQAPARTEPVANAGEVEREEWVTVFGFSIGDTNLILREFEKCGVILRHHSGPRDGNWIHILYQVIIHLSTVVLPYFCCTIYFNFL

SEQ ID NO: 16753 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 16754 - protein, 623 aa, Emericella nidulans
MRLLALTSALALLGKAVHGLDADGWRSQSIYFLLTDRFARTDGSTTAACDLAQRRYCGGSWQGIINQLDYIQDMGFTAIWITPITEQIPDVTAVGTGFHGYWQKNIYGVDTNLGTADDIRALSEALHDRGMYLMLDVVANHMSYGGPGGSTDFSIFTPFDSASYFHSYCAINNYDNQWQVENCFLGDDTVSLTDLNTQSSEVRDIWYDWIEDIVANYSVDGLRIDTVKHVEKDFWPGYIDAAGVYSVGEIFHGDPAYTCPYQDYMDGVMNYPIYYPLLNAFKSSSGSMSDLYNMINTVASNCRDPTLLGNFIENHDNPRFPNYTPDMSRAKNVLAFLFLTDGIPIVYAGQEQHYSGSNDPYNREPVWWSSYSTSSELYKFIATTNKIRKLAISKDSSYLTSRNTPFYSDSNYIAMRKGSGGSQVLTLLNNIGTSIGSYTFDLYDHGYNSGANLVELYTCSSVQVGSNGAISIPMTSGLPRVLVPAAWVSGSGLCGLTNPTSKTTTATTTSTTTCASATATAITVVFQERVQTAYGENVFLAGSISQLGNWDTTEAVALSAAQYTATDPLWTVAIELPVGTSFEFKFLKKRQDGSIVWESNPNRSAKVNEGCARTTQTISTSWR

SEQ ID NO: 16755 - protein, 459 aa, Anabaena variabilis
MLTQLPNPISVPSWWQLINWIADPIGFQKKYSQKYGDIFSMQLAGIGSFVILGEPQAIQEIFTQDSRFDIGRGNKLAEPLIGRTSLMLMDGDRHRRERKLLMPPFHGEKLQAYAQQICLITHQIASQWQIGQPFVARSAMQKLSLEVIIQIVFGLANGERYQQIKPLFTDWLNMTDSPLRSSMLFLKSLQQDWGNRSPWGQMKYQQRCIYDLLQAEIEEKRTKENERRGDVLSLMMAARDENGQAMTDEELKDELLTILFAGHETTATTIAWAFYQIFRNVNVREKLQQELDSLGENPNPMEIAQLPYLTAVCQETLRMYPVLPTLFPRITKSSINIAGYQLEPNTTLMASIYLIHYREDLYPHPQQFRPERFIERQYSPSEYIPFGGGSRRCLGYALALLEIKLVIATVLSNYQLALAEDKPIKVQRRGFTLAPEGGVRMIMTGKKSLRFEQSNKIFN

SEQ ID NO: 16756 - protein, 410 aa, Pseudomonas aeruginosa UCBPP-PA14
MPLVSACACDGGQLRPLDEALAELLARAPRPPACESLALERALGRVLGEDLLAPMDLPHWDNSAMDGYALCSADLPRSGGSLTVGARIAAGDTRGMSLPLGQAARIFTGAPLPTGADCVVPQELCVVDGERVQLPPVSAGQHVRRRGEELRRGAPVLRAGQRLRPQELGLLASLGVATVSVRRRLRIGLLSSGDELREPGQTLLAGQIYNANRYCIGALLRGLGFEVHDEEVLADELVASRDALSLAASEWDALVTSGGVSVGEEDHLKRAIAELGEVNLWRLAIQPGKPFAFGSVAGKPWLGLPGNPAAALVTALLVARPFLLRQQGLFDVVPRPLPLPAAFDWPQPRARRQYLRARLDERGRVEIHPQQGSAMLLAASWADGLAVIERGATLGVGDAIDFLPFSALMA

SEQ ID NO: 16757 - protein, 551 aa, Oryza sativa (japonica cultivar-group)
MAVSLLPAVLVLLAIVAPLLYLVLLPAVKYTTRNGAARWEDDGGDGRRRRRLPPSPRGLPLLGHLHLLGALPHRALRSLAAAHGPVLLLRLGRVPVVVVSSAAAAEEVMRSRDMEFASRPRMAMAELLLYGGRDVAFAPYGEYWRQARRICVVHLLSARRVLSFRRVREEEAAALVGRVRAAAADVVVDLSDLLIAYSNTVLTRIAFGDESARGGGGGGDRGRELRKVFDDFARLLGTEPMGELLPWFWWVDALRGIDGKVQRTFEALDGILERVIDDHRRRREGGRRMDDDGGGDHRDFVDVLLDVNETDKDAGIQLGTVEIKAIIMLICFLLHGHEQDMFVGGSDTTTTMMAWTMAELINHPRAMRKAQNEIWAVVGNTSHVTKDHVDKLPYLKAVFKETLRLHPPLPLLIPREPPADTQILGYTIPAHTRVVINAWAIGRDAAAWGQQPDEFSPEKFLNSTIDYKGQDFELLPFGAGRRGCPGIVFGVSAMEIALASLLYHFDWEAAATDHRRRGSQAWALPVDMSEVNGIAVHLKYGLHVVAKPRMP

SEQ ID NO: 16758 - protein, 307 aa, Oryza sativa (japonica cultivar-group)
MAGGFLSMANPAVTLSGVAGNIISFLVFLAPVATFLQVYKKKSTGGYSSVPYVVALFSSVLWIFYALVKTNSRPLLTINAFGCGVEAAYIVLYLVYAPRRARLRTLAFFLLLDVAAFALIVVTTLYLVPKPHQVKFLGSVCLAFSMAVFVAPLSIIFKVIKTKSVEFMPIGLSVCLTLSAVAWFCYGLFTKDPYVMYPNVGGFFFSCVQMGLYFWYRKPRNTAVLPTTSDSMSPISAAAAATQRVIELPAGTHAFTILSVSPIPILGVHKVEVVAAEQAADGVAAAAAADKELLQNKPEVIEITAAV

SEQ ID NO: 16759 - protein, 169 aa, Stigmatella aurantiaca
MADLSVRRGTGSTPQRTREWDPFQQMQELMNWDPFELANHPWFANRQGPPAFVPAFEVRETKEAYIFKADLPGVDEKDIEVTLTGDRVSVSGKREREKREESERFYAYERSFGSFSRAFTLPEGVDGDNVRADLKNGVLTLTLPKRPEVQPKRIQVASSGTEQKEHIKA

SEQ ID NO: 16760 - protein, 507 aa, Solanum melongena
MDVPCLWYSLLILLLLFIFLLIHHCFTTSKTQNMFLPPSPRKLPIIGNLHQLGSHPHRSLRKLSQKYGPVMLLHLGSKPVIVASSVDAARDILKTHDHVWATRPKYSIADSLLYGSKDVGFSPFGEYWWQVRSIVVLHLLSNKRVQSYRDVREEETANMIEKIRQGCDASVINLGEHLCFLTNNITSRVALGRTYDERESGIDAKDILEQFLQLLDTFNVGDYIPWLKWVNKITGLDTKVEKIAKKLDTFLDSVIEEHIIRNKKEEYAITDEAKDFVDVLLEIQNGKETDFPLQRDSLKAILLDAFAAGTDTIYTNLDWTMADVLRQPRAMKTLQNEVRGLAQGKSEITEDDLKNMQYLRAVIKESLRLHPPNSLLVPRESMEDVKLLGYYHIPARTQALINVWAIGRDPLSWENPEEFCPERFLNNDIDMKGLKFELLPFGSGRRGCPGSSFAIAVIELALARLVHKFNFALPKGTKPEDLDMTECTGIATRRKSPLPVVATPFSG

SEQ ID NO: 16761 - protein, 467 aa, Azotobacter vinelandii
MSKSLQLIKEHDVKWIDLRFTDTKGKQQHVTMPARDVDDDFFEYGKMFDGSSIAGWKGIEASDMILMPDDSTAVLDPFTEEPTLIIVCDIIEPSTMQGYDRDPRAIARRAEEYLKSTGIGDTAFFGPEPEFFIFDEVKYKSDISGSMFKIFSEQAAWNTDADFEGGNKGHRPGVKGGYFPVPPVDHDHEIRTAMCNALEEMGLKVEVHHHEVATAGQNEIGVSFNTLVAKADEVQTLKYCVHNVADAYGKTVTFMPKPLYGDNGSGMHVHMSIAKDGKNTFAGEGYAGLSDTALYFIGGIIKHGKALNGFTNPSTNSYKRLVPGFEAPVMLAYSARNRSASIRIPYVNSPKARRIEARFPDPSANPYLAFAALLMAGLDGIQNKIHPGDAADKNLYDLPPEEAKEIPQVCGSLKEALEELDKGRAFLTKGGVFSDDFIDAYLELKSEEEIKVRTFVHPLEYDLYYSV

SEQ ID NO: 16762 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 16763 - protein, 349 aa, Hordeum vulgare
MDRSSFGNLAAGGGGSSSSKSSPSFLQLQPLSTTTVAAGPGPMGGTYYGTPLALHQGAAAAGSSQSPYQFHHHKSSVGEISQAEAEAIKTKIMAHPQYTALLVAYLDCQKVGAPPDVLERLTAMAAKLDAHTPGRLHEARDPELDQFMEAYCNMLAKYREELTRPIEEAMEFLKRVEAQLDSITGGGHGSAPLSLAAGKYEGVGSSEDDMDASGRENEPPEIDPRAEDKDLKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGQFMADGMYRLGS

SEQ ID NO: 16764 - protein, 100 aa, Oryza sativa
  unsure (1)..(100): unsure at all Xaa locations
MAREVLISFNPPRWIPSGTKSGGWKQRGRVWRKSLSFWVHLXAKFPLVFIFFFIVLYAIPASAAVLLLNILITVLFALPSFLILYFAYPSLDWLVREIFA

SEQ ID NO: 16765 - protein, 454 aa, Sarcothalia crassifolia
  unsure (1)..(454): unsure at all Xaa locations
VKETDVLALFRVSPQPGVDPIEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGVICERERMDKFGRPFLGXTVKPKLGLSGKNYGRVVYEGLKGGLDFLKDDENINSQPFMRWKERYLYSMEAVNRSIAASGETKGHYLNVTSATMEEMYERAEFAKQLGSIIIMIDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGDDVVLQFGGGTIGHPDGIQAGATANRVALESIVIARNEGRDYVTEGPQILQDAAKTCGPLQTALDLWKDISFNYTSTDTADFVETPTANV

SEQ ID NO: 16766 - protein, 221 aa, Zea mays
MEKAGQHEHVIGIPVNNRAFGIEEPDFPSNGPAKNAAAGAGGRRRVTGDRVAQGLKEHVTLGPKLYETVKGKLSLGARILRAGGVGKVFRRWFSSPVGGGGERLLRASQCYLSTTAGPIAGMLFVSTERVAFRSDRSLALPLTSPAGGGSGTTTVLRVPYKVSIPLRRVAAARPGQNRDRPEHKYVQVVTRDGFDFWFMGFVRYQASLQELEKAVAQSQSQ

SEQ ID NO: 16767 - protein, 115 aa, Nostoc sp. PCC 7120
MTGKGQGFGFGLGKMKELAEAFKKAQQVQEGAKRLQEELEQMEIQGEAGGGLVKVIVSGNQEPKRVEISPDALAQGADLLSDLVTAAMKDAYIKSTATMRERMEDLTSGLELPGF

SEQ ID NO: 16768 - protein, 485 aa, Agrobacterium tumefaciens str. C58 (U. Washington)
MTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 16769 - protein, 125 aa, Oryza sativa
MQAVAAAAGMMRRGSLTIDPAGEEEAPAERVGRLVRESPVVVFARRGCYMAHVMRRLLAAVGAHATVIELEGGAAEEEEAALGGGAALPALFVGGDPVGGLEGLMGLHLSGRLVPRLREVGALCT

SEQ ID NO: 16770 - protein, 463 aa, Delftia acidovorans
MNTVDITEIIEKQKPNRKVLALLILSFLIMFCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEESARIAGWKDSVKALFGGQLSKITPALWGAFVCSSVTVFFLASWIPVLTVGTGRSASLAAVGLALFSAGGAFGGIFSSRIIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMSADRANDPEARPIVA

SEQ ID NO: 16771 - protein, 154 aa, Triticum aestivum
  unsure (1)..(154): unsure at all Xaa locations
SATSVAPFQGLKSTAGLPVSRRSNGASLGSVSNGGRIRCMQVWPIEGIKKFETLSYLPPLSTEALLKQVDYLIRSKWVPCLEFSKLGSSSXEHNASPGYYDGRYWXTMWXLPXFGCTDXTQVIXRLEGVKEGYPDPKSDHRQMVSACVTSSPTT

SEQ ID NO: 16772 - protein, 303 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQTILKLPGFSDNIFTHILAGLGAGFFAVCIGSPVDVMKSRMMGDSAYKSTFDCFIKTLKNDGLLAFYKGFIPNFGRLGSWNVIMFLTLEQVKKFFIKEVPN

SEQ ID NO: 16773 - protein, 715 aa, Arabidopsis thaliana
MWRLRIGAKAKDNTHLFTTNNYVGRQIWEFDANAGSPEELAEVEEARRNFSNNRSRFKASADLLWRMQFLREKKFEQKIPRVIVEDAEKITYEDAKTALRRGLLYFTALQADDGHWPAENAGSIFFNAPFVICLYITGHLEKIFTHEHRVELLRYMYNHQNEDGGWGLHVESPSNMFCSVINYICLRILGVEAGHDDKGSACARARKWILDHGGATYSPLIGKAWLSVLGVYDWSGCKPIPPEFWFLPSFFPVNGGTLWIYLRDIFMGLSYLYGKNFVATSTPLILQLREEIYPEPYTNISWRQARNRCAKEDLYYPQSFLQDLFWKGVHVFSENILNRWPFNNLIRQRALRTTMELVHYHDEATRYITGGSVPKVIASDYFKKHLARVPDFIWIGEDGLKIQSFGSQVWDTALSLHVFIDGFDDDVDEEIRSTLLKGYDYLEKSQVTENPPGDYMKMFRHMAKGGWTFSDQDQGWPCCLFFESMSSEFIGKKMDVEKLYDAVDFLLYLQDIIFVSRYVECTGSAIVALAQFNKQFPGYKKEEVERFITKGVKYIEDLQMVDGSWYGNWGVCFIYGTFFAVRGLVAAGKCYNNCEAIRRAVRFILDTQNTEGGWGESYLSCPRKKYIPLIGNKTNVVNTGQALMVLIMGNQMKRDPLPVHRAAKVLINSQMDNGDFPQQEIMGVFKMNVMLHFPTYRNMFTLWALTHYTKALRGL

SEQ ID NO: 16774 - protein, 217 aa, Glycine max; identical to SEQ ID NO: 7160

SEQ ID NO: 16775 - protein, 511 aa, Zea mays
LPHPKAPPPPRVKTSKSIAQVAGEAATAAVETMEDALGSAVGPHFSGLRLDSRRLSLSPSSSPSRSASGNGTLVAAPGLAFPKAEDGTRKPFVIGVCGGTASGKTTVCDAIIQQLHDHRVALVNQDSFYHGLTEEQSEHVQDYNFDHPDAFDTDRLLECMGKLTSGQSVNIPIYDFKNHRRCSEKFRKVNESDVIILEGILVFHDQRVRDLMDMKIFVDADADTRLARRVRRDTVERGRDVTSVLEQYVRFVKPAFDAFVLPSKKYADVIIPRGGDNLVAIDLIVQHINTKLGQHNLCKAYPNVFVVHTTFQIRGMHTLIRDKNITTPDFVFYSDRLIRLVVEHGLGHLPFTEKQVVTPTGSLYMGVDFCKKLCGVSIIRSGESMENALRACCKGIKIGKILFHRIGDNGQQLIYHKLPVDIAERHVLLLDPVLGTGNSANQAIELLMSKGVPEDRIIFLTLVSAPEGIHCVCKRFPHLKIVTSEIDSGLNDEYRVIPGLGEYGDRYFGTD

SEQ ID NO: 16776 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 16777 - protein, 701 aa, Xanthomonas oryzae
MAKSSGKPASAVSVDRSASAPDARGTGDELHQKARGRHPQLTTNQGIPVGDNQNSLRATPRGPTLLEDFILREKITHFDHERIPERIVHARGSASHGYFKLTKSLSQYTTAKIFTEVGEKTPLFTRFSTVAGGAGSVDTPRDVRGFAVKFYTKEGNWDLVGNNIPVFFIQDAIKFPDLIHAVKMEPDRGFPQAASAHDTFWDFISLTPESMHMIMWAMSDRTIPRSLRMIEGFGIHSFRFLNDKGESTFVKFHWRPKLGLQSTIWDEAVKIAGADQDFPPRDLFEAIQNGDFPEWELGVQLFTEAEADAFPFDHLDSTKIIPEELVPLQIVGRMVLDRWPDNFFAETEQVAYCPANIVPGIDFSNDPLLQGRLFSYLDTQLSRLGGPNFHQIPINAPKCPFANNQRDGHMQMDVPKARVAYEPSLLQADAPREALRGFPSHSTPAEDGAKGRVRAERFADHYSQARLFFRSQTAPEQAHMASALVFELSKVETAHVREAIVGHLRHIDQKLAQRVADGMGMTTLPPAPPAAVAPIDMPLSPALQVIGKMKDTLKGRTVGILIHDGSDASTIKAVRKAAEAEGATVKIVAPKLGGAKLSDGKQLAADGQLAGTPSVVFDAVAVLLSSEAAKLLTRESAALDFVSCAWAHLKAIAFDEGAQLLLKAGNIGKDAGVVPAADTKAFISAAKTRQWAREPKVRMLA

SEQ ID NO: 16778 - protein, 615 aa, Zea mays
  unsure (1)..(615): unsure at all Xaa locations
IADRCDKKGVSVDERLIRVAEMLEKMVESYSPKDLPNAAVSPDVAKVSSSSINEESDGPSPKLSDWSRRGSADMLDYLQETDNTISLDDIKNLPSMTCKTRFGPKSDHGMATSSAGSMTPRSPLTPRSNHIDMLLAGKNAINESGDLPQIVELADIARCIANTPLDEESALSQMVTCIEDLQEIVNRRKHEALTVQTFGTRIEKLHREKYLQLCDSVDMDKVDSTSTIMDEEDDVVRSLRASPVHPIKDRTSIDDFEIMKPISRGAFGRVFLAKKRTTGDLFAIKVLRKADMIRKNAVESILAERDILITVRNPFVVRFFYSFTSRENLYLVMEYLNGGDLYSLLRNLGCLDEDVARVYLAEVVLALEYLHSMHIVHRDLKPDNLLIAHDGHIKLTDFGLSKVGLINSTDLSGPAVSGASLYGDDEPQMNELEQMDHRARRQNRSAVGTPDYLAPEILLGTGHGCSADWWSVGVILFELIVGIPPFNAEHPEAIFENIMNRKIPWPHVPEEMSFDAQDLIDRLLTEDPHQRLGANGASEXEDSSDNGSLSGSSSCVSNQDDMGEDSTGLNEFESSANVNYSFSNFSFKNLSQLASINYDLLTKGLKDDPPPRTEM

SEQ ID NO: 16779 - protein, 348 aa, Pyrobaculum aerophilum str. IM2
MLLPEIDFAYDEPDVGYQKVRLHFNENLFLPEEYYRAVAAPLEPWEVRYYTDPNNKKLAAAIERYLGLPQGSVVITAGADEGLRLAMQLAAHMGRGIVIVEPTYGMARVVARQVGLRPQIATYGGDLSLDVDGILKLGAGAVYLCSPNNPTAHLVKEVEELAAKFNGLVILDSAYAEFAGYWRPRFYEYGNVAEVRTFSKAWGLAGLRVGYVVAYGKLAEALRALSPPHPISSLSAKIVERALEVGRPYVERSVEEVKEVREWVLPQIQAEKFAGPVNFVTLKVQEAEGVAGLLEKRGFVVRVLGGKPLCPACIRFTLAPRPIMERFLQALTAALNNRKQQTKPAGGV

SEQ ID NO: 16780 - protein, 104 aa, Salmonella enterica
AGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 16781 - protein, 323 aa, Oryza sativa (japonica cultivar-group)
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 16782 - protein, 387 aa, Spinacia oleracea
METSMACCSRSIVLPRVSPQHSSALVPSSINLKSLKSSSLFGESLRMTTKSSVRVNKAKNSSLVTKCELGDSLEEFLAKATTDKGLIRLMMCMGEALRTIGFKVRTASCGGTQCVNTFGDEQLAIDVLADKLLFEALNYSHFCKYACSEELPELQDMGGPVDGGFSVAFDPLDGSSIVDTNFSVGTIFGVWPGDKLTGVTGRDQVAAAMGIYGPRTTYVLALKDYPGTHEFLLLDEGKWQHVKETTEINEGKLFCPGNLRATSDNADYAKLIQYYIKEKYTLRYTGGMVPDVNQIIVKEKGIFTNVISPTAKAKLRLLFEVAPLGFLIEKAGGHSSEGTKSVLDIEVKNLDDRTQVAYGSLNEIIRFEKTLYGSSRLEEPVPVGAAA

SEQ ID NO: 16783 - protein, 465 aa, Candida albicans
MFPNSPDAFHQVRMMQSLIKASNFKLQSMEFRCHSNNVCEYQMEMLHHLLSVEAKTLPSLSLIEQQPEIKLGMRPLLLDFLMEVITILNLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 16784 - protein, 344 aa, Glycine max
  unsure (1)..(344): unsure at all Xaa locations
MDHSADAHRTDLMTITRFVLNEQSKHPESRXGDFTILLSHIVLGCKFVCSAVSKAGLAKLIGLAGETNVQGEEQKKLDVLSNEVFIKALISSGRTCILVSEEDEEAIIVEPSKRGKLYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 16785 - protein, 359 aa, Zea mays; identical to SEQ ID NO: 5905

SEQ ID NO: 16786 - protein, 241 aa, Ralstonia eutropha
MHATEPNTGHGSQRAIRLAPSILSADFARLGEEVCAIEAGGADLVHFDVMDNHYVPNLTIGPLVCEAIRPLVSIPIDVHLMVEPVDALIPMFAKAGANLISFHPEASRHVDRTIGLIRDHGCKAGLVLNPATPLSWLDHTLDKLDLVLLMSVNPGFGGQAFIPGVLDKVRQARARIDRQVAAGGRPVWLEIDGGVKADNITEIARAGADTFVAGSAVFGAPDADGGYRGILHRLREAATIT

SEQ ID NO: 16787 - protein, 138 aa, Yersinia enterocolitica
TAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 16788 - protein, 316 aa, Triticum aestivum
  unsure (1)..(316): unsure at all Xaa locations
MDHAADAQRTDLMTITRHALNEQGRHPESRGDFTILLSHIVLGCKFVASAVNKAGLAKLIGLAGETNVQCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRALYEVFPMSFLMEQAGGQSFTGKHRALEIVPXEIHQRSPIFLGSYDDVEEIKSLYAAESSTA

SEQ ID NO: 16789 - protein, 393 aa, Magnetococcus sp. MC-1
MPLVTKRGHPLSTIKRSPKPAPLSRPTAPFTNPCSTACVMSPWDAIDVKQTFWTQPATLEIKNMAKIDVFGIGNALVDQVYAVEESFLTQIGEEKGRMSLVDPQRQAELSRALASTPALRACGGSAANSLIALTQLGGSAFHACRVAEDETGHFFAQDLTANGVQHQLHTLPAGSSGSCMVFITPDAERTMCTFLGASADLQPEDVPDAILTTAQWCYVEGYLVTAPNTLAAALKGLQQARANGVKTALSFSDVNMVKFFRDGFSQMLGESGVDLIFCNAEEALAFAETDDMAQATAALKKQSRTFVITLGAEGALLWDGQQEIQVAGQPAKAIDTNGAGDMFAGAFFYGITQGWDFTKAAQLACRCCAVLVTHAGARLPKSRTQEILAQFVP

SEQ ID NO: 16790 - protein, 447 aa, Methanosarcina acetivorans C2A
MVQMKKCTTKEDVLEAVKERDVKFIRTQFTDTLGIIKSWAIPAEQLEEAFENGVMFDGSSIQGFTRIEESDMKLVLDPSTFRILPWRPATGAVARILGDVYLPDGKPFQGDPRYVLKTAISEAEKMGFSMNVGPELEFFLFKLDANGNPTTELTDQGGYFDFAPLDRAQDVRRDIDYALEHMGFQIEASHHEVAPSQHEIDFRFSDVLNTADNVVTFKYVVKSIAYHKGYYATFMPKPLFGENGSGMHSNQSLFKNGKNAFYDPDTPMQLSQDAMYYIGGLMSHIKEFTAITNPVINSYKRLVPGYEAPIYITWSSKNRSSLIRIPATRGEGTRVELRCPDPSCNPYLAFALMLRAGLDGIKSKIDPGEATNVNIFHLTEKERAERSIHSLPGDLKEAIDEMKGSQFVKEVLGEHVFSHYLCAKEMEWDEYKAIVHPWELEKYLPML

SEQ ID NO: 16791 - protein, 506 aa, Candida tropicalis
MIEQVLHYWYYVLPAFIIHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 16792 - protein, 203 aa, Sorghum bicolor
MAEPGLEGSQPVDLSKHPSGIVPTLHFPVLGASKRANIVLNSWGFGGNYLVVILSPRVDFRNIVSTVNLDCKLDLKAIALQARNAEYNPKRFAAVIMRIREPKTTALIFASGKMYARIIQKLGFPAKFKDFKIQNIVGSCDVKFPIRLEGLAYSHGAFSSYEPELFPGLIYRMKQPKIVLLIFVSGKIVLTGAKMTQVKVTFF

SEQ ID NO: 16793 - protein, 453 aa, Pseudomonas putida KT2440
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 16794 - protein, 111 aa, Triticum aestivum
  unsure (1)..(111): unsure at all Xaa locations
MAKHHPDLIMCRKQPGIAIGRLCEKCDGKCVICDSYVRPCTXRPXSGDECNYGSFRGRCVICGGVGISDAYYCKECTQQEKDRDGCPKIVNLGSAKTDLFYERKKYGFKKR

SEQ ID NO: 16795 - protein, 414 aa, Triticum aestivum
MAFDAFTDKTAVFRRLKAKPENKMCFDCNAKNPTWASVTYGIFLCLDCSAFHRSLGVHITFVRSTNLDSWTPDQLKMMAFGGNNRAHAFFKQHGWTEGSGKVDSKYTSRAAELYRQILQKEVAKSSTVNVLPSSPVAASQPPNPTDDFPDFKLADAPEETTNGKHEPVVANPPREPAQAPKAPTHPTYVSSVKKPLGAKKLGAKTGGLGVKKLTTKSNESLYDQKPEEPKPALPTMTTTTSAAKSGPSSHSRFQYMENEPSTESKTGGGNKTGHVAAPKTSDFFHEYGMDNGFQRKTSTAASKTQIEETDEARKKFSNAKAISSSQYFGNTDREQKEAQLSLQKFSGSSSISSADLFGRDTNDSDLDASAADLINRISFQASQDLSSLKNMAGETGKKLTSFASNFITDLDRIL

SEQ ID NO: 16796 - protein, 238 aa, Pachysandra terminalis
VQLRRMENKINRQVTFAKRRNGLLKKAYELSVLCDAEVALIIFSARGKLYEFCSSSSMQNTLERYQKCSYGPLEPSQPAKETQSSYLEYMRLKARVEGLQRSQRNLFGENLGPLSTKELEQLEHQLEMSLNQIRSTKTQFMLDQLSDLQRKEQMLQEANRSLKRKLEESNAENSLGPSWESGGHGVPFGHQPAQSEGFFQPLECNSTLQIGYNHVGADQMSITVPPQNVNGFVPGWMV

SEQ ID NO: 16797 - protein, 305 aa, Zea mays
RDGLEAGPGSLQPAEHSQLTQAPYLCSIVGTRVSRARRDSAGMARWRARRLLPLATFVTLGMILGSLLQLALLHRLDGYSVHADSDPEAVLLRLGYVKPEVISWTPRIIVFHNFLSSEECDYLMAIARPRLQISTVVDVATGKGVKSDVRTSSGMFVNSEERKSPVVQAIEKRISVFSQIPKENGELIQVLRYEASQYYRPHHDYFSDTFNLKRGGQRVATMLMYLTDGVVGGETHFPQAGDGECSCGGNVVKGLCVKPNKGDAVLFWSMGLDGNTDPNSIHSGCPVLKGEKWSATKWMRQKMTF

SEQ ID NO: 16798 - protein, 411 aa, Pinus sylvestris
MASATLSMAAVANCSSTHASLQVSGKGFSEYSGLKSSSGFPCLRKYNEELRFQLVAFQTNAVGSSGQKRGVVEAKIKVAINGFGRIGRNFLRCWHGRKDSPLDVVVINDTGGVKQASHLLKYDSILGTFDPDVQVAGNDGISVDGKVIKVVSDRNPVNLPWKDYEIDLVIEGPGVFVDREGAGKHLQAGAKKVLITAPGKGDIPTYVCGVNEDKYYPAEEIISNASCTTNCLAPFVKVLDQKFGIIKGTMTTTHSYTGDQRLLDASHRDLRRARAAALNIVPTSTGAAKAVALVLPSLKGKLNGIALRVPTPNVSVVDLVVQVEKKTFAEEVNAAFRETADKELKGILAVCDEPLVSIDFRCSDVSSTVDSSLTMVMGDDMVKVVAWYDNEWGYSQRVVDLADIVANNWKS

SEQ ID NO: 16799 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEDQ

SEQ ID NO: 16800 - protein, 323 aa, Bifidobacterium longum NCC2705
MAPSKLDWFGWANPIRSIMKRDTKQRRNEGKLMTQNRAELNRNLAQMLKGGVIMDVTTPEQAKIAQDAGACAVMALERIPADIRAAGGVSRMSDPAMIKGIQEAVSIPVMAKVRIGHIAEARILQAIEIDYIDESEVLSPADDVYHIDKNQFDVPFVCGAKNLGEALRRIAEGAAMIRTKGEPGTGDVIQAVRHMRTMNKQIRELVGLRDDEVYEAAKQLAVPYDLAKYVHDNGRLPVVNFAAGGVATPADAALMMELGAEGVFVGSGIFKSGDPAKRAAAIVKATANWQDADLLAKLSENLGEAMVGINEDEIQTIMAARGE

SEQ ID NO: 16801 - protein, 546 aa, Neurospora crassa
MAQAIRSALPDRLMPSNGDEEFAKRHHGKTRSHMVSTILSLCHHPSNKMTVQEELTHRQAFENTSTSIAAAQMRNALTKLAETVKDPDQKKLFETEMDNFFSLFRRYLNDKAKGNEVNWDKIAPPAPHQIVDYESLANNNSVDFLNKLAVLKLNGGLGTSMGCVGPKSVIEVRDGMSFLDMSVRQVEHLNRTYGSNVPILLMNSFNTDDDTAAIIKKYEGHNVDILTFNQSRYPRIYKDSLLPVPKSFDSPLHDWYPPGHGDVFESLYNSGILDKLIERGIEIIFLSNADNLGAVVDLRILQHMVETDAEYIMELTNKTKADVKGGTIIDYEGSVRLLEIAQVPKEHVNEFKSIKKFKYFNTNNIWMNVQAVKRVVENNELELEIIPNEKTIPGDKKGESDISIVQLETAVGAAIKHFKGAHGVNVPRRRFLPVKTCSDLMLVKSDLYTVKHGQLQMSSARFGDAPLIKLGNDFKKVSDFQKRIPSIPKIIELDHLTITGAVNLGRGVTLKGTVIIVATEGQTIDIPPGSILENVVVQGSLRLLEH

SEQ ID NO: 16802 - protein, 528 aa, Lycopersicon esculentum
MAVGDNDNNNLQVLNALDLAKTQLYHFTAIVIAGMGFFTDAYDLFSISLVTKLLGRLYYTKPDLLKPGTLPPAVSASVTGVALVGTLAGQLFFGWLGDKMGRKKVYGMTLVLMVVCSVASGLSFGSTPKGVMTTLCFFRFWLGFGIGGDYPLSATIMSEYANKKTRGAFIAAVFAMQGFGILFSGIVALITAAGFDHAYRSPTFEENAALSTVPQSDYIWRIILMFGSLPAALTYYWRMKMPETARYTALVAKDAKRAAQDMGKVLQVEIESEEAKIEQISRNETNQFGLFSWEFVRRHGLHLFGTCSTWFLLDIAFYSQNLFQKDVFSAVGWIPKAPTMNAVQEVYKIARAQTLIALCSTVPGYWFTVAFIDIIGRFAIQLMGFFFMTVFMFAIAIPYHHWTLEANRIGFIVMYSLTFFFANFGPNATTFVVPAEIFPARLRSTCHGISAAAGKAGAIVGAYGFLYAAQSKDPNKTDAGYPAGIGIKNSLIVLGCINALGMLCTFCVPEPKGKSLEEASQETITGEA

SEQ ID NO: 16803 - protein, 254 aa, Glycine max
MWRLKIGDGGKNPYIFSTNNFLGRETWEFDPETSTIEERTQVKAACENFYKNRFKTRACGDRLWRFQFLREKNFRQTITSVKIQDDEEITNEKTTNTLKRAIHYLSALQTSNGYWPAQFSGPLFPTALFVMCMYITGHLDSIFPEEYRKEILRYIYFHQNEDGGWGLNIDGHSTRFSTTLNYICMRILGEGPNGGHNNAGAKARKWIHDHGSVTHIPSWGKFWLSVLGVVDWCGSNPLPPEFWILPTFSPMHPG

SEQ ID NO: 16804 - protein, 335 aa, Spinacia oleracea
KLKVAINGFGRIGRNFLRCWHGKDSPLDVVVINDTGGVKQASHLLKYDSILGTFDADVKTAGDSAISVGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADQELKGILSVCDEPLVSIDFRCTDVSSTIDSSLTMVMGDDMVKVIAWYDNEWGYSQRVVDLADIVANKWQA

SEQ ID NO: 16805 - protein, 229 aa, Zea mays
MKNVAKCDTWCELQNPANHRVFERKLRPKPSGGGHVCLGVTPRERIQRHPDRGNQSIPLDSIPHKARHKRTKPMASDGSGVVTVYGSNGAELLEPSKQPKSATFSVKVGLAQMLRGGVIMDVVTPEQARLAEEAGACAVMALERVPADIRAQGGVERMSYPCLIRRHQARRSPSPGHWAQRARHSGGNFFGGGGPKILRGGGGGGSPPLFGKKKRGCFPPPPKKGAHTY

SEQ ID NO: 16806 - protein, 262 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGCCFGDDDDDDRYDNPVCSEQITATTQAQAQQGNGYIPGWML

SEQ ID NO: 16807 - protein, 167 aa, Mesembryanthemum crystallinum
QSIDIDGKKVKAQIWDTAGQERFRAVTSAYYRGAVGALVVYDITRRTTFDSISRWLDELKTHSDTTVARMLVGNKCDLDDIRAVSTDEGKSLAEEHGLFFIETSAKDSTNVKTSFEIVIKEIYCSVSRKVLNSDSYKAELSVNRVSLVNDDKQKQNQGYISSSCCSG

SEQ ID NO: 16808 - protein, 316 aa, Shigella flexneri 2a str. 301
MNELDGIKQFTTVVADSCDIESIRHYHPQDATANPSLLLKAAGLSQYEHLIDDAIAWGKKNGKTQEQQVVAACDKLAVNFGAEILKIVPGCVSTEVDARLSFDKEKSIEKARHLVDLYQQQGVEKSRILIKLASTWEGIRAAEELEKEGINCNLTLLFSFTQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 16809 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 16810 - protein, 138 aa, Zea mays
MDNLLASLDKNEAEISPSTLYAIACVFEGVPFVNGSPQNTFVPEISKSSVVDDMVASNPILYKPDEHPDHVIVIKYIPYVGDSKRAMDEYTSEIFMGGKNTIVLHNTCEDSLLASPIILDLVLLAELSTRIQLKAEGQ

SEQ ID NO: 16811 - protein, 89 aa, Triticum aestivum
  unsure (1)..(89): unsure at all Xaa locations
GGHGIVGAHVPLGCGLSFAQKYRKEDTVSFSLYGDGADYQGQFFEALNISSLWKLPAIPGXENNHYGMGTAEWRAVKSPFYYKRGDYVP

SEQ ID NO: 16812 - protein, 145 aa, Streptococcus pyogenes MGAS8232
METSDELKQRIGDLSYEVTQHAATESPFTGEYDDFFEKGIYIDIVSGEVLFSSLDKFNSGCGWPAFSKPIENRMVTNHDDSSYGMRRVEVKSREAGSHLGHVFSDGPKEAGGLRYCINSAALKFIPYEQMEKEGYAQWLTLFDET

SEQ ID NO: 16813 - protein, 449 aa, Zea mays
  unsure (1)..(449): unsure at all Xaa locations
MPTRNHNAAAAAAPQHHHHNRGGAPALGKSKAVPGRADAMNRRAPLGDIGNLVSVRPAEGXLSCRSRSIXPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILADWIIEVHHKFALMPETLYLTMYIIDQYLSLQPVLRRELQLVGVSAMLIACKYEEIWAPEVNDFILISDSAYSREQILSMEKGILNSLEWNLTVPTVYMFLVRFLKAATLGNKVEKEMENMVFFFAELALMQYGLVTRLPSLVAASVVYAARLTLKRAPLWTDTLKHHTGFRESETELIECTXCWSAHTRPXADSKLRSVYKKYSSEQFGGVALRPPAAAVEIK

SEQ ID NO: 16814 - protein, 492 aa, Helianthus annuus
MDPYKYRSSSAYNAPFWTTNSGAPVYNNNNSLTVGSRGPILLEDYHLVEKLANFDRERIPERVVHARGASAKGFFEVTHDITALTCADFLRAPGVQTPVIVRFSTVIHERGSPETLRDPRGFAVKFYTREGNFDLVGNNFPVFFIRDGMKFPDMVHSLKPNPKSHIQEDWRIMDFFSHHPESLHMFTFLLDDIGVPQDYRHMDGSGVNTYTLINKAGKAYYVKFHWKPTCGVKSLLEEEAIKIGGANHSHATQDLYDSIAAGNYPEWKLFIQTIDPDHEDRLDFDPLDVTKTWPEDIFPLQPVGRLVLNKNIDNFFAENEQLAFCPAIIVPGIYYSDDKLLQTRIFSYSDTQRHRLGPNYLQLPANAPKCAHHNNHYDGFMNFMHRDEEIDYFPSRYDPARHAEQYPIPPVRLSGKRDKCVIEKENNFKQPGERYRSFSPDRQERFINRVVGGLSDPRVTHEVRSIWVSYWSQADKSLGQKIASRLNVKPNY

SEQ ID NO: 16815 - protein, 305 aa, Streptococcus pneumoniae
GFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWY

SEQ ID NO: 16816 - protein, 473 aa, Gelidium amansii
YESGVIPYAKMGYWDPNYAVKETDVLALFRITPQPGVDAVEASAAVAGESSTATWTVVWTDLLTACDLYRAKAYKVDKVPNSDDQFFAWISYDIDLFEEGSIANLTASIIGNVFGFKAVQALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPLMIQGFYNTLLMSHLDEDLPKGIFFEQDWASLRKVTPVASGGIHCGQMHQLLDYLGDDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 16817 - protein, 164 aa, Aminomonas aminovorus
SAVGLVAKYPNLLVTHTLSKARSLAGLRVGYAIGQPHLIEALVRVKDSFNSYPLDRFAITGAVAAIEDKAYFEDTCRKVIATRETLIADLQALGFVVLPSAANFIFARHGERSGAELAASLRERSIIVRHFSKPARISDFLRITIGTDIQSQALVNALTEILTA

SEQ ID NO: 16818 - protein, 255 aa, Malus x domestica
MGRGRVQLKRIENKINRQVTFSKRRSGLMKKAHEISVLCDAEVALIIFSTKGKLFEYSNDSCMERILERYERYSYTERQLLANDNESTGSWTLEHAKLKARVEVLQRNQRHYMGEDLQSLSLKELQNLEQQLDSALKHIRSRKNQVMYESISELQKKDKALQEQNNLLAKKVKEKENAVAQQAQLEHVQEQRLNSSSSLLPRALQSLNFGSGSNYQAIRSSEGIPGDNQQYGDETPTPHRPNMLLPAWIVRHLNE

SEQ ID NO: 16819 - protein, 172 aa, Triticum aestivum
  unsure (1)..(172): unsure at all Xaa locations
ASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATQXINEVEEXKKEYPDAYVRIIGQHRSYFIASSTGARVARLTTTRAHVHSFT

SEQ ID NO: 16820 - protein, 198 aa, Glycine max
  unsure (1)..(198): unsure at all Xaa locations
MSFAYQTDGYQLVASQAPPIFMRKGKSIVLGVFVLLRWYSVPLAAGLSEGISLGMHEALVLRDGRSDYLGKGVXKAVDYANTDLGPALIGKDPPEQTDIDNLMVXQLDGTANERGRSKLKLGTNAILXKCVEICINEASMLKNPIYKHIVNIXGDKKPDLPVPASKVNKGGSHAXDKLAMNEGIALPVGATYVKETMM

SEQ ID NO: 16821 - protein, 103 aa, Triticum aestivum
HLDLVGSFTPAMRECDDEALRRGRVFIDFEAALEEARELVAALRPGGPRGGGVPRALARRPAGTRAGRRSDDEITVFKSVGTAVVVLLAAQLAYENYTATKNA

SEQ ID NO: 16822 - protein, 301 aa, Zea mays
MSESARPAVARKIVKSLQRCTRHSLERPPFETALGEYCQFPRPSLSPATAAAATSGGRGEVDEGIFVRTPLKRKAPYGEYDTAESTGWSIVSSGFIHGVDSPRKTPISGKTARKYKPKSERTKAAPQAATLNAAGSPGNPPTPAGCRYDNSLALLTKKFINLLNEAQDGILDLNSTAETLGVRKRRMYDITNVLEEIGLIEKKLKNRICWKGLGELGTNLDNDLSVLKIDFENFNLQEQALDEHISKIREKLKDLTEDEGNQRWLFLTEDDIKGLPCFQNKTLIAIKAPRGSSLEVPNPDV

SEQ ID NO: 16823 - protein, 353 aa, Neurospora crassa
MGCGMSTEEKEGKARNEEIENQLKRDRMQQRNEIKMLLLGAGESGKSTILKQMKLIHEGGYSRDERESFKEIIFSNTVQSMRVILEAMESLELPLADQRVEYHVQTIFMQPAQIEGDVLPPEVGNAIEALWRDAGVQSCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 16824 - protein, 490 aa, Rhizobium etli
MTVMESTRTEADGQVFAEEDLGYHKALKPRQIQMIAIGGAIGTGLFLGAGGRLAAAGPALVLVYALCGFFAFLVLRALGELIVHRPTSGSFVSYAREFYGEKLAFAVGWMYWLTWAMTAVADVTAVALYMNFFKAYVPWIAMIDQWVFAFAALVLVLSMNLLSVKVFGELEFWFSLVKVLALLIFLIVGVYFVVTGTPIDGHVPGLNTITDFGGMFPNSVLPALVVIQGVVFAYASIELIGTAAGETENARKVMPRAIRTVVLRLVVFYVGSVLLLSLLLPYTAYKGGESPFVTFFGKIGIQGADVVMNLVVLTAVLSSLNAGLYSTGRILHSMAVSGSAPAALAKMNRSGVPYGGIAVTAVVTAFGVVLNAVVPAEAFEIGLNVAALGIIAAWGVIVLCQLKLWQLSRQGKLARPEFRMFGAPYTGLLTLGFLAIVVILMALDYPVGTYTVASLLLIIPALVVGWLLMRERIHMIAAEQGDERGGFDLA

SEQ ID NO: 16825 - protein, 178 aa, Zea mays
FPPCRKSISGAEMYDPENDVWTSIPDLHQTHNSACSGLVVNGKVHVLPKGLSTVQVLESVKLGWDVKDYGWPQGPMVVVEDVLYVMSHGLVFKQKGDTWKMVASASEFKRRIGMAMTSLSDEVLIVGGVIGPDRLNWDIKPLSDVDALTVGNDRPAWRSVAPMTRCRGTILGCTQLTI

SEQ ID NO: 16826 - protein, 287 aa, Triticum aestivum
  unsure (1)..(287): unsure at all Xaa locations
ALPGFIIMYVWHYCTVKRYEFEMHSKVSMAWILGLGPSLGLVRVPGIGFVYTELASGVPHIFSHFITNLPAIHSVVVFVCVKFLPVYTVPVEERFLVRRIGPKNFHIFRCIARYGYKDLXKKDDDFEKMLFDCLTLFIRLESMMDGYSDSDEFSLPEQRTEGSINTAFLADKTVNTMCSNGDLSYSSQDSIVPARAPPGANRPVXFSRLTLPSGTGFLPGLIRCRDAGVVXPILGNTIVRARRDSGIIKKISVDYLYAFMRRICRENSVMFNIPHESLLNVGQIYYI

SEQ ID NO: 16827 - protein, 510 aa, Oryza sativa (japonica cultivar-group)
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAGA

SEQ ID NO: 16828 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTAHGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 16829 - protein, 95 aa, Zea mays
ADVVVAPPFIYIDQVKNSLTGRIEVSAQNVWIGKGGAYTGEISAEQLVDIGCQWVILGHSERRHIIGENDEEKLLEEREAGKTFEVCFEQMKAFA

SEQ ID NO: 16830 - protein, 419 aa, Prionitis cornea
DTDVLALFRVTPQPGVDAVEASAAVAGESSTATWTVVWTDLLTACDLYRAKAYKVDAVPNSCEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVIARNEGLDYVAEGPQILQDAAKTC

SEQ ID NO: 16831 - protein, 532 aa, Oryza sativa (japonica cultivar-group)
MAAGDQAADDPDSLRLLQLGYKQELKRGLSTLSNFAFSFANISVLTGVTATYNTGLRYGGPVSMTLGWLVVALFNGCVALSMAEICSAYPTSGGLYYWSAKLAGKEWASLASWVTGWFNIVGQWAAIASVDFSLAQLLQVIILLSTGGANGGGYMASKYVVLVICAVILILHGVINSLPIQWLSLFGQIGAIWNAAGVFVLVILIPAVAKDRPSVEFVFTHLNTDNGMGIHSKAYILAVGLLMSQYSVLGYDTSAHMVEETKNADRSGPIGIITSVVCATVFGWIYLLALTTAVTDIPYLLSPGNDAGGYAIAQALYTAFHRRFGSGAGGIACLGAVAVAIFLCGIACVTSNSRDGAMPLSRVWYRVNKHEVPLNVVWLAVAVAFFMALTVNYYIPSCTRCCFCSSCVRCSDTSLGSQVAFQALGSIATLGMYIAYALPVFFRVTTARRSFVPGPFNLGKYGVLVGWVGVVWVATVTVLFSLPVAYPVANKETFNYTPVAVGGVLLLSVGAWVLHARFWFQGPITNTSDGPI

SEQ ID NO: 16832 - protein, 522 aa, Candida tropicalis
MSIQDIVETYSTKWYVVVLVALIVYKVFDFFYARYLMYKLGAKPFLQSQTDGYLGFRVPFELMGKKSEGTLIDFTYQRTLELDNPDIPTFTFPIFSVLIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 16833 - protein, 120 aa, Zea mays
  unsure (1)..(120): unsure at all Xaa locations
TVSFGYDSTKLQELDEMNLLLREMEDESAALREMHAKVGKDMLDPNATTSENRDEMDSLSVFVGNVDYACTPEEVQPHFNSXGTSYRVTILTDKSVQPKGSAYVEFVEDEAAQEAIKLNE

SEQ ID NO: 16834 - protein, 447 aa, Mycobacterium tuberculosis CDC1551
MDDGSVSDIKRGRAARNAKLASIPVGFAGRAALGLGKRLTGKSKDEVTAELMEKAANQLFTVLGELKGGAMKVGQALSVMEAAIPDEFGEPYREALTKLQKDAPPLPASKVHRVLDGQLGTKWRERFSSFNDTPVASASIGQVHKAIWSDGREVAVKIQYPGADEALRADLKTMQRMVGVLKQLSPGADVQGMVDELVERTEMELDYRLEAANQRAFAKAYHDHPRFQVPHVVASAPKVVIQEWIEGVPMAEIIRHGTTEQRDLIGTLLAELTFDAPRRLGLMHGDAHPGNFMLLPDGRMGIIDFGAVAPMPGGFPIELGMTIRLAREKNYDLLLPTMEKAGLIQRGRQVSVREIDEMLRQYVEPIQVEVFHYTRKWLQKMTVSQIDRSVAQIRTARQMDLPAKLAIPMRVIASVGAILCQLDAHVPIKALSEELIPGFAEPDAIVV

SEQ ID NO: 16835 - protein, 605 aa, Fragaria x ananassa
MDTKIGSIDVCKTENHDVGCLPNSATSTVQNSVPSTSLSSADATLGRHLARRLVQIGVTDVFTVPGDFNLTLLDHLIAEPGLTNIGCCNELNAGYAADGYARSRGVGACVVTFTVGGLSVLNAIAGAYSENLPVICIVGGPNSNDYGTNRILHHTIGLPDFSQELRCFQTVTCFQAVVNNLEDAHEMIDTAISTALKESKPVYISIGCNLAGIPHPTFSREPVPFSLSPKLSNKWGLEAAVEAAAEFLNKAVKPVMVGGPKLRSAHAGDAFVELADASGFALAVMPSAKGQVPEHHPHFIGTYWGAVSTAFCAEIVESADAYLFAGPIFNDYSSVGYSLLLKKEKAIIVQPDRVTIGNGPTFGCVLMKDFLLGLAKKLKHNNTAHENYRRIFVPDGHPLKAAPKEPLRVNVLFKHIQNMLSAETAVIAETGDSWFNCQKLKLPPGCGYEFQMQYGSIGWSVGATLGYAQAVPEKRVISFIGDGSFQVTAQDVSTMIRNGQRTIIFLINNGGYTIEVEIHDGPYNVIKNWNYTGLVDAIHNGEGKCWTTKVRCEEELIEAIETANGPKKDSFCFIEVIVHKDDTSKELLEWGSRVSAANSRPPNPQ

SEQ ID NO: 16836 - protein, 255 aa, Salmonella typhimurium LT2
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 16837 - protein, 469 aa, Gelidium vagum
VIPYAKMGYWDPDYVVKETDVLALFRITPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPEMIRGFYNTLLLTHLDTNLVQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 16838 - protein, 380 aa, Vibrio parahaemolyticus RIMD 2210633
MKKISKLLVGFSFALPVLFLLLSKTGTADTMDKMKALENAEIATLAGGCFWCTESDLEQLPGVLDVVSGYSGGHVKNPTYRQVSSGKTGHIESIEVKYDPNVVNYEQVLDYFFRHIDPTDDKGSFVDRGPQYRPAIFYHNAEQKQIAEQFMMEIDNAKVYPKPLKTELIKFETFYPAEEYHQDYYKKSSLKYKYYRYASGRDKYLDEVFGDDRKEHPKTLRQLIDEKKLLSKVKAYNKPSQSKIKSTLTELQYYVTQEEGTERPFDNEYWDNKEAGIYVDIVTGEPLFSSTDKYKSGTGWPSFTKPINPGYIVEKTDYKLIYPRTEVRSKFGDSHLGHVFTDGPKPTGLRYCMNSAAMKFVPVSKMAQLGYGDYLFLFEQ

SEQ ID NO: 16839 - protein, 505 aa, Neurospora crassa
MGIIHEKAHYVVAVALVAFLIRAFVLSQWNTIKRNGERLKKPPNTLPLVGNGLQFLQSRWKLFSWFDACQRKFGYETVAISVPTLPPGVLIHDPRNLDYVFKNEGIFTKGNFVKGRTWDLFGNGIINAEGDFWKTQRKAGLSFLNTANLRVLTDVALPQYLSESISQLRSSTNGTVVDLQHMAMHADDEFTVSFDYASGGTAERFQNPLWFVTEIFLGAELRKSIAVVKNFGRHIVTKAVQDRQEKEFGEEEGKLDQISGSLIQSLLDAIQDEQMVADAALTYLSAGRDTTGQALTWTFYLLMRHPRVVAKIREEATQLLKEKNVTLTPDQFDSSLFNPVTMPYSMAVFYEVLRLYPPIPFEIRQCNEDVTLPDGTFLPKSSILVWCLWAMQRSKLTWGDDADEFRPERFLDGNKLISRSPSEFPVFYGGPRTCLGRKMAEAIAAQVIPTMACLFDFVPTSDEERTSKTSLTLPMEGGLPVTVKTLTGEEREKLVRIPEIRFSEH

SEQ ID NO: 16840 - protein, 245 aa, Lolium perenne
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRARKNQLMHESISELQKKERSLQEENKILQKELIEKQKAHTQQAQWEQTQPQTSSSSSSFMMGEATPATNCSNPPAAASDRAEDATGQPSARTVLPPWMVSHINNG

SEQ ID NO: 16841 - protein, 453 aa, Streptomyces coelicolor A3(2)
MDKQQEFVIRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALARTSDLGFTFYTHPEIEFFLLKDKPVDGSVPTPADNSGYFDHTPQNIGMDFRRQAITMLESMGISVEFSHHEGAPGQQEIDLRYADALSTADNVMTFRLVMKQVALEQGLQATFMPKPFSEYPGSGMHTHLSLFEGDRNAFYESGAEYQLSKVGRSFIAGLLRHAAEISAVTNQWVNSYKRIWGGTERTAGAGGEAPSYICWGHNNRSALVRVPMYKPGKTGSARVEVRSIDSGANPYLTYAVLLAAGLKGIEEGYELPPGAEDDVWALSDAERRALGIEPLPQNLGEALALMERSDLVAETLGEHVFDFFLRNKRQEWEEYRSQVTAFELRKSLPVL

SEQ ID NO: 16842 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAADLTKRIQNAGTEVVEAKAGGGSATLSMGQAAARFGLSLVRALQGEKGVVECAYVEGDGQYARFFSQPLLLGKNGVEERKSIGTLSAFEQRSLEG

SEQ ID NO: 16843 - protein, 174 aa, Zea mays
MEDEEHEVYGQEIPVDGEDVDMSAGDDATKELDEMKRRLKEMEEEAAALREMQAKVAKDMQDPNATTSENKEEMDSRSVFVGNHVDYACTPEEVQQHFNSCGTVNRVTILTDKFGHPKGFAYVEFVEVEPVQEAIKLNESELHGRQLKVAPKRTNVLGMKHPPGGGFNPSRPKG

SEQ ID NO: 16844 - protein, 390 aa, Oryza sativa (japonica cultivar-group)
  unsure (1)..(390): unsure at all Xaa locations
FFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPKPTTRGASCSCSAPIPALLTYYWRMKMPETARYTALVAKNAKQAAADMTQVLNVEIVEEQNKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFAXXGPXA

SEQ ID NO: 16845 - protein, 484 aa, Gracilariopsis panamensis
CRRRTRIKNDRYESGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTHLEINLPQGIFFEQDWASLRKVTPVASGGIHCGQMHQLLDYLGNDVVLQFGGGTIGHPDGIQAGATANRVALEAMVMARNEGRDYVAEGPEILRVAAKTCGPLQTALDLWKDITFNYTSTDTADFVETPTANV

SEQ ID NO: 16846 - protein, 242 aa, Zea mays subsp. mexicana
SIRNNPVQNKLMNSEDPINNNHTQTAGGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPPPPIRDSIVGYFSAPAADDDASVGNGFLRLQAQEPASMVVGATLSATEMNRVAAATHCAGAMELIQTAMG

SEQ ID NO: 16847 - protein, 179 aa, Triticum aestivum
MQSQIVCHGCRSVLLYPRGAPSVCCAVCHAVTNAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 16848 - protein, 403 aa, Synechococcus sp. PCC 7942
MILSYSAAIELLLAEVAQLPLAIERVPLLETGDRLLAKDLAAPCDLPHWDNSAMDGFALRSQDVAAASPDRPVRLPVVGRVMAGEQPPLLANPTGVACAVMTGAPIPAGFDVIVKVEDVVQEENAIAVSTPIPAGQFIRRQGEDLRQGSPLLAKGQRLTPMALMLAAAVGMGELPVWSKLPVGLISTGTEVVPWSQPTLELGQIRNSSQPFLIEQLQRLGCEVRAIAHVPDDPEQFAAIAQQFWSQGVRLLLTTGAVSMGVADFVPAALERLGCQTIFHKVAIRPGKPLLFAIAPEHQGLVLACPGNPVSTTVTAEFFLKPLLMACRNEVRSPLWLPLAESVRKPEGLQCFWRSRLTPEGKVWVDPQQSSAALKSLVESTHWAILPAGQDFLAAGTPVEVRSL

SEQ ID NO: 16849 - protein, 324 aa, Candida glabrata
MKESAMLSWCAENFGDVEPMPIEMGSDELCKILYSDEYKLLLGLCRRLMSLGELSQRALLLTAKVIAIAPAFYTVWNYRYSIIKEQLSSLDKVEQGALVNKELDWLDEVTLSNPKNYQIWSYRQALLKVHPSPQLKRELPIIQLMIDEDTKNYHVWSYRKWCVLFFKDFNHELPFTDMMIRRDIYNNSAWTHRMFVWQHTESSSTQVIAEIDNYLRGKIELAPQNISCWTYLRGLYELFLHENYDPSIIRFAEGFIDGVLDSDSTAEKIETIESSYALEFLAHVYSRNPSTQEKALRAYQLLSDKFDPIRANLWQHKIKQLKSS

SEQ ID NO: 16850 - protein, 191 aa, Triticum aestivum
  unsure (1)..(191): unsure at all Xaa locations
IKHLLPKXDVVYISEGANTMDIGRXFFDVHQPRHRIDAGTGATMGVGMGYAIAAQSYYGPAKRVVSIVGDSAFGFSAMELETAIRSKLPLLIIVINNNGIYHGLDDSEYNASLNNGTLPTTALLPETRYEMISQACGGKGWLVKDKVELRKALKEALDSKDQTCVINVLIAPGGRKKLAFAWQQKTEKARL

SEQ ID NO: 16851 - protein, 178 aa, Zymomonas mobilis
AYAEYLDPECDDGALALAKNTKNVLVTRTFSKIYGLAAERIGWAYACPEIIDALNRIRAPFNVTIAGQKAAVAALEDQAFIQNSFKHSKKVAWLVENQMALLSNVGIRVIPSSANFTLLLFEGSLTAKTAYKALMDHGYTTRWLPGQRLPHALRITIGSEKHMQDVAGILTSLVRQAL

SEQ ID NO: 16852 - protein, 90 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVS

SEQ ID NO: 16853 - protein, 460 aa, Caulobacter crescentus CB15
MSVEQGEILRGGPGAGVPDRDGAHRSLSRPQAVGVAIAGLLAALGVALAPMESMVATHHLFFFIFLLGGLTRLAAAMTPLPRHHSPALAEADLPSYTLITPLYREAEVLPELVASLAAIDYPRDRLQALIVLEADDEVTRAAARALDLPSFIQVLVVPPGTPRTKPRACNYALERARGDLVVIYDAEDMPDPGQLREAAARFAASDARLACLQAPLRIEDPGFSLFLPSQFRLEYAAHFEVLLPALARWGLPFPLGGTSNHFKIAPLREIGAWDPYNVTEDADVGFRLAAAGYRLDVIHRPTWETAPTTRAQWFPQRARWIKGHMQTLAVHARGPVPRQPRNAIALILTLAQSVASSHLHGPVMGVAIALALVDFLPDAAFQIPPHDLVLYFAGWGAAALAGARGVMRAGGRPKALHLLGMPAYWLCQSVAAVKALHQFVTAPHHWDKTLHTPRSGRPRA

SEQ ID NO: 16854 - protein, 583 aa, Xylella fastidiosa Dixon
MNRSAHSATRNGASWLTHALEAEGVDTLFGYPGGTIMPFYDALVDSRLTHILVRHEQGAALAANGYARASGRVGVCVATSGPGASNLITGIADAMLDSVPMVCLTGQVPSSLLGTDAFQELDVFGLTMPIVKHSFLVRSIQDLPSMVQDAFRIAREGRPGPVLIDLPKDVQMTDASHLQDHVSAAVMAPPQAEAAMIIEAAAAIASAEKPVIYGGGGIALADAVNVFRTFVDTTSIPTTLTLRGLGALPHAHPHYLGMLGMHGTRAANMAIQECDLLLVIGARFDDRATGKVNEFAPFARIVHLDADAYEINKLRNADIAVPGNLVTTLTALSASLSPSTAHPHISSSRYEWHERCIGNRERFGVRYDAPGNDIYAPALLKRLSEMAPVDTIIACDVGQHQMWVAQHCKFEDPRNHLTSGGLGTMGFGLPAAMGAQFAYPERTVVLVSGDGSFMMNVQELTTIARCKLPLKIVLLDNNSLGMVRQWQELFFAERYSEIDLSDNPDFTALVQVFGIPAKRITVRSDVEQGLAYLLAQPGPALLHVQIDARANVWPLVPPNTANSTMLESNPAHVQKETPHAIPA

SEQ ID NO: 16855 - protein, 417 aa, Streptomyces coelicolor A3(2)
MSASPSASSRGSRTGVWLIGARGSVATTVVAGCAAVTAGLHPPTGMVTETPDFAGAGLPALPALVFGGHDTVDCPLPKRAEALAAGGVLPHGLPSAVHAELAAADREIRPGGPLPGDTRDEEELIAAFAADITDFARRSGVDRTVVVNVASTEPAPAGGALPASSLYAAAALRAGCPYVNFTPSTGLHHPALSAPAEASGLPYAGRDGKTGQTLLRSVLGPMFAQRALAVRAWSGTNLLGGGDGAALADPAAAAAKNAGKERVLADTLGAPVEGEVHIDDVPVLGDWKTAWDHIAFDGFLGARMFLQTTWQGCDSSLAAPLVLDLARLVARAHQRGLSGPLGELGFFFKDPVGDGPSALAEQYGELKRFAGRLREDADGAPVDGDGGEGGANGSAGQSGDAVAVRPGGRGVEGGAGR

SEQ ID NO: 16856 - protein, 66 aa, Triticum aestivum
CTADGDVKYVPSMLDPTRQAEQYPIPPPVLSGCREKCIMREENEFRQAGYRYRSFYPASADRLLQC

SEQ ID NO: 16857 - protein, 269 aa, Arabidopsis thaliana
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 16858 - protein, 166 aa, Glycine max
  unsure (1)..(166): unsure at all Xaa locations
MVFFFATAGIMFQDITTLLLDPKAFKDTIDLFVERYKGKNISVVAGIEARGFIFGPPIALAIGAKFVPLRKPKKLPGKVISQEYILEYGRDCLEMHVGAVEPGERALVVDDLIATGGTLCAAMDLLERVGAEVVECACVIELPEXSKGRERLNGKPLYVLVEYVEI

SEQ ID NO: 16859 - protein, 314 aa, Dermocarpa sp.
NGFGRIGRLVFRAGLNNPNIEFVGINDLVPPGNIAYLLKYDSTHGRFAGTVESQSDGIVVNGKFIPCVSIRNPEELPWSKYGVEYVVESTGLFTTHETASKHLTAVQKRVVISAPTKDPERVKTLLVGVNHQTFDPSKDTIVSNASCTTNCLAPIAKVINDNFGLAEGLMTTVHAMTATQPTVDGPSKKDFRGGRGAAQNIIPASTGAAKAVTLVLPELKGKLTGMAFRVPTPDVSAVDLTFRTEKATSYQEICAAMKQAAEGEMKGILGYTEEPVVSTDFTSDPHSSIFDAGAGIELNSNFFKVVAWYDNEWG

SEQ ID NO: 16860 - protein, 50 aa, Escherichia coli CFT073
MGWVEAADLIVKGMEGAINAKTVTYDFERLMEGAKLLKCSEFGDAIIKNM

SEQ ID NO: 16861 - protein, 451 aa, Bangia atropurpurea
TDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGEIKGHYLNVTAATMEDMYERAEFSKVVGSIICMIDLVIGYTAIQSMAIWARKNDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANV

SEQ ID NO: 16862 - protein, 312 aa, Triticum aestivum
  unsure (1)..(312): unsure at all Xaa locations
MALVLLLTLLCIAFPAYLRNPVSVASCFTGADVRAAAAAQPAASASAALVADDGGRRPGQLRILLGVHTMPKKHSRRHLIRMAYALQQMAALRGAARVDVRFALCARPMPPEHGAFVALERRAYGDVLLFNCTENAEDGKTYTYFXDLPAMLGASGGEGRRPPYDYVMKVDDDTYLRLDALVETLRRAPREDMYYGVGLPFMDRVSPPFMLGMGYALSWDLVQWITASDMVRRKAKGVEDVTMGNWPDEGGKAKNRVNIFPRMYDYKSAEAKDFLEDTIGVHQLKADIRWAHTLAHFNATSGDLRPSREGSS

SEQ ID NO: 16863 - protein, 221 aa, Triticum aestivum
  unsure (1)..(221): unsure at all Xaa locations
MVLEAVMVVVDNSESSRNSDYQPTRFDSQVDAVNITFQSITQGNPESSVGLMSMGGKGPEVLVTLTTEQGKILEGLHRTKKKIGGSSHLKTGIQVATLALKHRQNRSQRQRIIVFVCSPVEESEKELTTLAKKMKKANISVDFVLFGDLDDDSTKNKLQLFIDTVKTNEGCHLVVIPPSSKLLSDQLVSXPILLGENAGGSGGAGGAGGGNDXVEFGFDPA

SEQ ID NO: 16864 - protein, 319 aa, Prunus persica
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEQGYLKKAFYGTNGPTFGTKVSNYPPCPNPELIKGLRAHTDAGGLILLFQDDKVSGLQLLKDGQWIDVPPMRHSIVINLGDQLEVITNGKYKSVEHRVIAQTDGTRMSIASFYNPGSDAVIYPAPTLVEKEAEEKNQVYPKFVFEDYMKLYAGLKFQPKEPRFEAMKAVETNISLGPIATA

SEQ ID NO: 16865 - protein, 400 aa, Xanthomonas axonopodis pv. citri str. 306
MNTALSRRTFLRDSALFAGAAGAASLPLLASAIERSTAIAPTPATALTPVMIDSNEFPEGPSAAAVRAIAQIAPQGGRYLRQVQMELMTTLAAELKLPVDHLMAYAGSTEPLDYTMLAFTSPSAALVTADPTYESGWRAATRNGARLIKVPLRKDFSHDVQAMCAADANAGVIYICNPNNPTGSVTARKDLDYALAHKPKGSVLVVDEAYIHFAQSTRSMVDMVAAGEDVVVLRTFSKLYGMAGIRLGYAAARPDLLAKLKFYSVNSLPVTAAAAGLASLRDPALVPQRRARTAATRTDVMDFLARQGYACTASESNCFMVDVKRPAAGFKDDMATHGVFIGRSWPVWPTWSRITVGTDAEMARFKHAFVQVVAGNRGPLPAPGVATAAADPMDAFFRYA

SEQ ID NO: 16866 - protein, 335 aa, Prochlorococcus marinus subsp. marinus str. CCMP1375
MTSLLDQLSSMTVVVADTGDLEAIRTFKPQDATTNPSLILAAAQIPAYQNLIDKSLQASRQRVGSFASAKEVVDEALDEVCVTFGKEILKIIPGRVSTEVDARLSFNTQATINKARKIIDLYKKVDISKERVLIKVASTWEGIKAAEVLESEGIHCNLTLLFGFSQAVACAEAGVTLISPFVGRILDWYKAETGKDSYAGEEDPGVVSVTKIFNYYKSNNYKTEVMGASFRNIDEILELAGCDLLTIAPKFLEQLENSDSKLTRKLDSLKPLPSETKIHLEEYDFRNMLKLDRMATEKLEEGIINFSKAIEQLEQLLSKRLSYIESGSNAELSIA

SEQ ID NO: 16867 - protein, 203 aa, Ananas comosus
VPGNSAGTVTTFYLSSQGSMHDEIDFEFLGNLSGDPYILHTNIYSQGKGNREQQFYLWFDPTKDFHTYSALWNPTHIVFFVDGTPIREFKNNERIGVPFPNSQMMKVYSSLWDGEDWATRGGLVKTDWSQAPFTAAFRGLSTDGCTSGIAACSKANNPYMWQQDLDSANQQKLKWVQKNYMVYNYCTDVKRFPQGLPPECSAN

SEQ ID NO: 16868 - protein, 108 aa, Zea mays
MEDEEHEVYGQEIPVDGEDVDMAAGDDATKLQELDDMKRRLKEMEEEAAALREMQAKVAKEMQGVDPNATTSENKEEMDSRSVFIGNVDYAWCLRYQVVFLGQKKKKK

SEQ ID NO: 16869 - protein, 384 aa, Nicotiana tabacum
MKKQEKEAIMADLENCGRVTRLAKKRAAEAMASHQQQHPSKKRVVLGEIQNFSNLGVSQIKGLNTEPKKQPKSKQQQSKRKLKRAVTSKIDKEELNVDNVDANYDDPQMCSAYVSDIYDYLRKMEIEEKRRPLPDYLEKVQKDLSPNMRGVLVDWLVEVAEEYKLLSDTLYLAVSYIDRFLSTNVITRQKLQLLGVSSMLISAKYEEISPPHVEDFCYITDNTYTKEEVVKMEADVLKTLNFEMGNPTVKTFLRRFTGVAQEDYKTPNLQLEFLGYYLAELSILDYSCVKYVPSLLAAAVVFLSRFTLQPNTHPWSLALQQYSGYKAADLKECILILHDLQLSRRGGSLAAVRDKYKQHKFKCVSSLTSPVEIPASFFEDMRQL

SEQ ID NO: 16870 - protein, 240 aa, Ehrlichia ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 16871 - protein, 260 aa, Zea mays
  unsure (1)..(260): unsure at all Xaa locations
MAATLSSVAAPSLPKHVSVTRAQQQAPPSIISASTKTAFHGVSLVVDRRWAAGPXRGSGRRRLLQVNARTAAKNIEVEVEKPLGLALGQKPGGGVVITSVESGGNAARAGLKTGDQVLYTSSFFGDELWPADKLGFTKTAIQAKSDSVYFVVSRGAEVDVKRLPKRPAPPRFGRKLTDSQKERATHVCLDCGYIYFLPKPFDEQPDDYGCPQCNAPKKRFARYDAATGKAIGGALPPIAVIVSLVIGIAGVGALLVYGLQ

SEQ ID NO: 16872 - protein, 290 aa, Oceanobacillus iheyensis HTE831
MQNKTIIVTGANTGMGLATTIELAKKGIHVIMACRDTKRGNEAKEKAMEESNSTNISLYQCDLGSMESISKFADQIKEDFDKIDGLINNAGVVSLKHTKTEDGFESMTGVNHLGHFLLTHLLLDVLKKSEQARIINVASGAYKAGTLDYNDMHFNNRSFNVIKGYGQSKLCNILFTLELNKHLEGTNVSTFALHPGAVSTSLGVDRQTGFGEKVHLLLRPFFLTSEEGAETAIYLATEPKIDHLSGRYFYKKKLQPTKYNKVNEDEAKKLWDWSIKELGMEHKAIEEVAP

SEQ ID NO: 16873 - protein, 198 aa, Oryza sativa
MDPCMVRPPSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHSLKPNPRSHVQEYWRVFDFLSHHPESLHTFFFLFDDVGWAGG

SEQ ID NO: 16874 - protein, 110 aa, Zea mays; identical to SEQ ID NO: 14516

SEQ ID NO: 16875 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFEPSRRITVDEALCHPYLAPLHDINEEPVCVRPFNFDFEQPTLTEENIKELIYRETVKFNPQDSV

SEQ ID NO: 16876 - protein, 1112 aa, Neurospora crassa
MASFGHAVPAAAPRPGPYGAAYGAPVAVSAPAAPAGTFAPGTKIQCGSHRVVIQKYLSEGGFAHVYLVKLPAAVNGTDLAVLKRVAVPDKEALRGMRTEVETMKRLKGHKAIVTYIDSHASEMRGTGGYEVFLLMEYCNGGGLIDFMNTRLQHRLTEPEILNIFSDVAEGVACMHYLKPPLLHRDLKVENVLINMVGSVRKFKLCDFGSAAPPRPAPTTVTECRLVDEDIQKHTTMQYRSPEMVDVYRKQPIDEKSDIWALGVLLYKLCYYTTPFEEGGTLAILNASYKFHTYPVFSDRLKKLIAWMLQENQQARPNIYQVLREACAMQGKEPPIYTGTHVDTRKREHSLSQARSPPVVGAVFAAPVVQQQVIPEVERMRRGRLPAPSQPVSQPTTPSPGPGKVTNGDPFAALDTKLPLKNADELSNKFPTLDQFSLLHDKGTKFDFDSGVPQPPQQQKDISQRVAERLADEVFKVKPSPSSTPGPMSQRVSLDLNKGNPYAAAMESQRISPSVNPASTLPRQGEPSRASAMISNIPELKAISSPNAQSPFQTPPPTRPKMVSTGTMTESPPPVYRFPPAEHHRAASVPRQQETGPTSYTRAATTVLLSPGAAGSPSAPLQGQMHTAQAHHPRSSRPSLEGGRPSFDAFDLPTRSKEPESSSSRSRPASIYLESDLTYLREKEAAAKPLHSPSLSASRFSLDKGPPSPKLEEERNIRSSVEFLRSMEDSDTKKKDKGTKHHSKRSSLSSLSAGTKNLFAGKFGDAFKRFEGGTNNSGPPRSPSPLKDVDAELDRFNKLTPIAGSEVNDDRSDDGRRFEDDHIDEMTPEMRREEEARMLAAEEARVAAAQAEYRARVAQRTGTGSATGPTPLPKSIGGVPRAVSIQNKVQSLLDESSRSAPVSRTAHGYGHYTDADAGGPRGSTDSLGDSRPAVAKKPIAITGQPVSGSLPRPPTSSGMSSMEQTMTGRASITVTGGKPAAPPKPTRLTANLTAGGGAGSPPRQPYSTSTISLHRQLGPGTPSSSLIDSDRSDSIGARAGGDYSRTSREALVAVEGLPGQDSPMLLQMSASEKDDYIKDFQKRFPSLTSIEMVETDVGARSGTRGDGERDVAR

SEQ ID NO: 16877 - protein, 623 aa, Pichia pastoris
MLKLLCLLLPLVAVSASPIDLGSQKDYLVLDLPGLSHLSETQRPTMHAGLLPLNLSFVADDDTEYFFWRFSKQDVDRADIVFWLNGGPGCSSMDGALMELGPFVINPKQEVEYNEGTWVEAADVVFVDQPGGTGFSSTTNYLTELTEVADGFVTFLARYFHLFPADVYKKFTLGGESYAGQYVPYILKAIMDDLKSDSGQLPKELYLKGALIGNGWIDPNEQSLSYLEFFIKKELIDIHGSYMPGLLQQQEKCQNLINHSSGEASESQISYSACEKILNDALRFTRDKKAPLDQQCINMYDYTLRDTYPSCGMSWPPYLPDVTAFLQKKSVLEALHLDSSASWSECSARVGSHLKNKISVPSVDILPDLLQEIPIILFNGDHDIICNCIGTERMIDKLEFNGDQGFTEGTEYIPWFYNEVNVGKVISERNLTYVRVYNSSHMVPFDNTPVSRGLLDIYFDNFEDVEYNNVSGIATPVYDVDKNITYIDSNDPRLQNGPKSSSTDDSAAHGNPFFYYVFELFVIVLLLCGLVYLYQYYSNSAPHSILADKHKKKSKNKSKNVRFLDDLESNLDLDNTDDKKDNSVMSKLLSSMGYQAQEPYKPLDKGANADLDIEMDSHGTSEK

SEQ ID NO: 16878 - protein, 349 aa, Pectobacterium atrosepticum
MKRMFKALFVVVFVCFSSLANAAENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 16879 - protein, 198 aa, Arthrocormus schimperi
GGAKKVVISAPSKDAPMFVMGVNEEKYTDEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLERPASYDAIKAALKEASQGKLKGILGYTENEVVSSDFITDSRSSIVDAKAGIALNDTFVKLVA

SEQ ID NO: 16880 - protein, 319 aa, Streptococcus mutans UA159
MKRILVLHTGGTISMHADKAGRVVPDSDNPMNHASVKLDDIQINAIDFLNIPSPQITVEHMLLLTQKIRETAGLYDGVVITHGTDTLEETAYFLDTMILPQIPIVLTGAMRSSNELGSDGVYNYLSALRVASHDNAADKGVLVVMNDEIHAAKYVTKTHTTNVSTFQTPTHGPLGIIMKHDILFFKTAEPRVRFRLESLTGTVPIIKAYAGMGDWLLNILDKSSIDGLVVEALGAGNLPPEAAQSITKLIQEGIPVALVSRCFNGIAEPVYAYQGGGVKLQEAGVMFVRELNAPKARLKLLIALNAGLKGQELKEYIEG

SEQ ID NO: 16881 - protein, 345 aa, Zea mays
VAPSLCDCVRVRVRVRSGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 16882 - protein, 52 aa, Glycine max
DGFVIRNKARENPENPSIELGPEFKKVSNFLSRYITVPSNGHHASLKVANHL

SEQ ID NO: 16883 - protein, 252 aa, Triticum aestivum; identical to SEQ ID NO: 14050

SEQ ID NO: 16884 - protein, 553 aa, Pichia stipitis
MSSQDIPSGVQTPSNASFLEKDEDKIEEVPQNHDATLVALESKGISEYLLICFFCLLVAFGGFVFGFDTGTISGFVNMSDFLERFGQTRADGTHYLSNVRVGLLVSIFNIGCAIGGIFLSKIGDVYGRRVGIMASMVIYVVGIIVQIASQHAWYQVMIGRAITGLAVGTVSVLSPLFIGESSPKHLRGTLVYCFQLCITLGIFIGYCVTYGTKRLSDSRQWRVPLGLCFLWAIFLVVGMLAMPESPRYLVEKKRIEDAKKSVARSNKLSPEDPSVYTEIQLIQAGIDREAIAGSASWTELITGKPAIFRRVVMGIIMQSLQQLTGVNYFFYYGTTIFQAVGLKDSFQTSIILGVVNFAATFIGIWAIERFGRRSCLLVGSAGMFVCFIIYSTIGSFHLYKDGEYNNDNTYKPSGNALIFITCLFIVFFASTWAGGVYTIISESYPLRIRSKAMAIATAANWVFGFLISFFTPFIVSAIHFKFGYVFSGCLLFSFFYVYFFVVETKGLSLEDVDELYASNVVPWKSSKWVPPSTAAMATEAGYAADEKPVDEHV

SEQ ID NO: 16885 - protein, 812 aa, Zea mays
  unsure (1)..(812): unsure at all Xaa locations
AANDACQQNGFVPDAHLGAEIALEDQRDLIRDLNASASVPPSRCQAFKDGMKQGIINPSDIDVTFEDFPYYVSENTKNVLLSCAFIHLEKKEFIKQFAEISSINQRILLSGPAGSEIYQETLVKALXKHFGARLLVVDSLLLPGAPLKDAESQKDSYTFREGDRVRYVGPAQLSSLSQRGPSYGYRGRVMLAFEDNGSSKIGVRFDKQIPDGNDLGGLCEEDHGFFCSAESLRPDFSAGEEVERLAMTELIEVISEENKSGPLIVLLKDVEKSFTGVTESLSSLRSKFESLPSGVLIIGSHTQMDSRKEKAHPGGFLFTKFASSSQTLFDLFPDSFGSRWLHERSKESPKAMKHLNKLFPNKISIQLPQDEALLTDWKQQLDRDVETLKAKSNIGSIRTFLSRNGIECNDIEELFIKDQSLSNENVDKIVGYAVSYHLKHNKIETSNSKDNKLVLTSESLKHGLNMLQSMQSDNKSSKKSLKDVVTENEFEKRLLVDVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRRFPRRLMVNLPDASNREKILKVILAKEELGSDVDLDSLANMTDGYSGSDLKNLCVTAXAHYPIREILEKEKKEKSLAKTEGRPEPALYGSEHIRPLSIDDFKSAHEQVCASVSSDSANMNELLQWNDLYGEGGSRKRKALSYFM

SEQ ID NO: 16886 - protein, 415 aa, Hordeum vulgare subsp. vulgare
YVLAIQRVASCLQSECEINNNCNLMSLACSKEMCFHFPWSSDMTALACDTNLTSFSQQNVPACLSGNGAFAYGIYKGALPVISSNSLAVKILYPIFWGLMTLSTFGNDLEPTSNWLEVIFSIINVLSGLMLFTLLIGNIQVFLHAVLARKRKMQLRFRDMEWWMRRRQLPSRLRQRVRKYERERWAAITGDEEMEMIKDLPEGLRRDIKRYLCLELVKQVPLFHGMDELILDNICDRLRPLVFCGGEKVIREGDPVQRMVFVLQGKLRSTQPLTKGVVAECVLGAGSFLGDELLSWCLRRPFVDRLPASSATFECVEAAQAFCLDAPDLRYITEHFRYKFANDKLKRTARYYSSNWRTWAAVNVQLAWRRYRARMMATAVLPPPPAGAAGPEDGDRRLRHYAAMFMSLRPHDHLE

SEQ ID NO: 16887 - protein, 379 aa, Bradyrhizobium japonicum USDA 110
MTKPTASPASCRQRRTSMLAIPLLSFALWSGGIGAAAHAAEPGKDASAGGLPRILVLATGGTIAGQADARATGAYKSGQITGEQLMQSVPGLDKLAKLNAEQISSIGSQDMNDKVWFALARRIQEAFDKNEADGVIVTHGTDTLEETAFFLDNVVRGDKPVVIVGSMRPASAVSADGPGNLYEAVQVAADPRSRGRGVMAVLNDKIEGARSVTKTNTTSIETFNSPNGGPIGYVDTAGGIRFMAQAAGLKRAAYQLPAGEQLPRVEIVYSHANMDAVPIEDAISHGAKGIVLAGVGDGNTSKPALDALEAAAKKGILVVRSTRVRSGFVTRNVEVDDDKNGFVVSEDLNPQKARVLTQLLIASGVTAPAELQRAFTATW

SEQ ID NO: 16888 - protein, 517 aa, Ralstonia metallidurans
MKIRAQVAMVLNLDKCIGCHTCSVTCKNVWTSREGVEYAWFNNVETKPGVGFPKEWENQDKWQGGWKRNADGSLTPRQGGKTKILANIFANPNLPQIDDYYEPFTFDYEHLQNAPLMQTPPTARPVSAITGKKMEKIEWGPNWEDDLGGEFDQRSRDKLFEDIQKDMYSTFENTFMMYLPRLCEHCLNPTCVASCPSGSVYKREEDGIVLVDQDKCRGWRMCVSGCPYKKIYFNWQTGKAEKCVFCYPRIEAGQPTVCSETCVGRIRYLGVMLYDADRIEQAASVADERDLYQSQLDVFLDPHDPKIQAEALRQGIPQSWLDAAVKSPVYKMACEWKVAFPLHPEYRTLPMVWYIPPLSPIQSAAESGFMGMNGVIPDVKSLRIPVKYLANLLTAGDVNPVLSALERMLAMRAYKRSESVDGLQDLAVLEQVGLTPAQVEDMYQIMAIANYEDRFVVPSSHKEMAEDSFDEKGSCGFSFGNGCSGGTSDGSLFGTKKPKPEVSYADLPRSRRKAITG

SEQ ID NO: 16889 - protein, 333 aa, Oryza sativa (japonica cultivar-group); identical to SEQ ID NO: 16035

SEQ ID NO: 16890 - protein, 488 aa, Vaucheria geminata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKLGTIIVMIDLVIGYTAIQSMAIWARKADMILHLHRAGNSTYARQKNHGINFRVICKWMRMAGVDHIHAGTVVGKLEGDPLMVKGFYNTLLETKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 16891 - protein, 621 aa, Leuconostoc mesenteroides subsp. mesenteroides ATCC 8293
MKALTTFLFLGGQVRMSDKKISAGLAALKVMEGWGVHTIYGIPSGTLSGLMDAMGHPENNIKFLQVKHEEVAAMAAVMQWKFGGKLGVAVGSGGPGATHLINGLYDAAMDNTPVLAILGSKPVRELNMDSFQELNQNPMYESIAVYNRRVATAEQLPHLVDDAIRTAIAKRGVAVLEIPADFGFSQIDANSIYSTPLYSSGPKYKEYKSAPVDNADIDAAVELLNQAKQPVIYAGVGTMGHGSAVQALSRKIKAPIITTGKNFETFDWDFEAFAGSNFRVGWKPANEAVLEADTVLFVGTNFPFSEVEGTFRNVDKFIQIDNNPAMLGKRHQNDVAILGDAGEAIDEILAKVSSVSESPWWQANIKNIQNWRDYMTKLEKKTEGDLQAYQVYNAINEHAADNAIFSIDVGNVTQLSVRHLHMTPKNMWRTSPLFASMGIGLPGGIGAKNTYPDRQVWNLIGDGAFSMTYPDVVTNVRYNLPVINVVFTNTEYGFIKNKYEDTNTYNFGVDFTDVDYAKIAEAQGAIGLTVSRIEDIDRVVQEALSYYGKGRVVVIDAKITKDRPIPVETLKLDKSLYSAETVNAYKEKYEAQELVPFREYLESEGLTSKYIKDSNDNKYSF

SEQ ID NO: 16892 - protein, 321 aa, Rubrivivax gelatinosus
MSRQPDSDPPDRDGQGFNTFRRRFLAGVATAGGAVVTAHATGAWGGQTLQDAMGSLLQDHYQRMTKDEIHAALERIERNARRRYGVDARCEDLPPLPNTVFGYALNISKCKGYRDCVEACVKENNLGRDSQMQYIRVLQMPDGTMDLEKAEHYYDAKQVPVPGHWYLPVQCMQCDNPPCVKACPTKATWKEPDGIVVVDYDWCIGCRYCMTACPYWARHFNWTEPQIPAAEFNPNLNYLGNRPRPKGVVEKCHFCSQRARKGRQPACQEACPTGARVFGNLLDPKSEIRWVLENKNVFRLKEDLGTEPKFWYFSDDRVSRA

SEQ ID NO: 16893 - protein, 332 aa, Novosphingobium aromaticivorans
MHELAFPLLVGLIALALAFDFLNGLHDAANSIATVVSTRLLSPVGAVIFAAGGNFAAYWLVGLHVADTIGKGIIDKDIVTPAVVFGALIGAMFWNVVTWIKGIPSSSSHALIGGLLGAGVMHGGFGAIESKKTIETFVAIFMSPMIGFALAMFFVLVTSWLFRGFQPRRAEGVFKGLHLLSSAAYSISHGGNDAQKTMGIITVLLYSTGYLKGEFHIPEWVVLSCYAAISLGTMSGGWKIIKTMGTKITRLNHHTGFCASSAGSIVVFGASALGIPVSTTHAITGSVIGTGAARRASAVRWGVAQRVVMAWFITIPASATVGAGFYLLTRLF

SEQ ID NO: 16894 - protein, 338 aa, Escherichia coli O157:H7
MQKKSIYVAYTGGTIGMQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAANYPINEVTLFFNNRLYRGNRTTKAHADGFDAFASPNLPPLLEAGIHIRRLNTPPAPHGEGELIVHPITPQPIGVVTIYPGISADVVRNFLRQPVKALILRSYGVGNAPQNKAFLQELQEASDRGIVVVNLTQCMSGKVNMGGYATGNALAHAGVIGGADMTVEATLTKLHYLLSQELDTETIRKAMSQNLRGELTPDD

SEQ ID NO: 16895 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPGLTDMVIFRGNSEDIYAGIEWKADSADAEKVIKFLREKMGVKKIRFPEHCGIGIKPCSKEGTKRLVRAAIEYAIANDRDSVTLVHKGNIMKFTEGAFKDWGYQLAREEFGGEPIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 16896 - protein, 578 aa, Oryza sativa; identical to SEQ ID NO: 10070

SEQ ID NO: 16897 - protein, 213 aa, Triticum monococcum
MSMSCGLCGANNCPRLMVSPIHHHHHHHQEHQLCEYQFFAHGNHHHHHHGSAADYPVPPPPDNFDHRRTWTRPFHETAAAGNSSRLTLEVGAGGQHMAHLVQPPARAHIVPFHGGAFTNTISNEAIMTIDTEMMVGPAHYPTMQERAAKVMRYREKRKRRRYDKQIRYESRKAYAELRPWVNGRFVKVPEAMASPSSPASPYDPSKLHLGWFR

SEQ ID NO: 16898 - protein, 469 aa, Brucella melitensis 16M
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEADKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 16899 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIHGGWGWRLSLGGAMVPALIITIGSLVLPDTPNSMIERGDREKAKAQLRRVRGIDDVEEEFNDLVAASESSRKVEHPWRNLLQRKYRPHLTMAVLIPFFQQLTGINVIMFYAPVLFSSIGFKDDSALMSAVITGVVNVVATCVSIYGVDKWGRRALFLEGGVQMVICQAVVAAAIGAKFGIDGNPGDLPKWYAVVVVLFICIYVSAFAWSWGPLGWLVPSEIFPLEIRSAAQSINVSVNMFFTFLIAQVFLTMLCHMKFGLFIFFAFFVLIMTFFIYFFLPETKGIPIEEMNQVWKAHPFWSRFVENDDYGNGVEMGRGTAIKEV

SEQ ID NO: 16900 - protein, 528 aa, Bifidobacterium longum DJO10A
  unsure (1)..(528): unsure at all Xaa locations
MGAARQTRLRARRGRRGQGRQRPGHDHPAVLRXXXXXXXXXXXXXXXXXXXXXXXXXXXXXXXXEAVKTGLLDESLIDDAVARILALKFRLGLFEDPRLPDAERIKAVIGSAEHQQINLELARESVALLRNDGTLPFAANTAKRIAVVGPLADDAQNQLGDWTGNSGQVSWMPDGQPRDMIATVLDGLIQLAADDCEVVYSRGANVIDLVPDPAGEFYPDGQPRPKIGVSAAVDQALIDEAVANARQSDLIVAVVGDVVQLVGETCSTATLELLGGQNALLDALAAVSRETGKPMVTVLISSKPQVLPASIVGEYGVFAKRVSDPETGTGSILWAPNPGMRGGQAIAEIILGLTNPSGRLPITFPRHAGQLPVYYNQIRGQHGDRYADLTQDPAFAFGEGLSYTTFAYGEPTIVGGASNADGTFAEADTVHAEITLANTGERAGVEIVQAYIGDIVTSYSWTDRELKAFQRVALEPGETKTVAFEIPVANCTIVDPDANRIVEPGEFELLIGHSSRREDLKRTTFTVA

SEQ ID NO: 16901 - protein, 149 aa, Zea mays
  unsure (1)..(149): unsure at all Xaa locations
MMSAKRIAHLAKKWQRMAAQRRQRITWGGAGAAAKQAGESCSSVASKGHCAVYTADGARFEVPLACLSTPVFRELLEMSQEEFGFSGGDGSGRITLPCDTAIMEYAMCLLRRSASAELEQAFLSTVAXTPCHYASRVAPCVGACQRVAV

SEQ ID NO: 16902 - protein, 497 aa, Nicotiana benthamiana
MKKATVGAAVVGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIIHQEFAEASIPPNLMVGTSEELFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPMPKSGEMVINMEWGNFRSSHLPLTQYDHALDTNSLNPGDQIFEKMTSGMYLGEILRRVLLRMAEEAGIFGDEVPPKLKSPFVLRTPDMSAMHHDTSSDLRVVGDKLKDILEISNTSLKTRRLVVELCNIVATRGARLAAAGVLGILKKMGRDTPRQGGPQKMVVAMDGGLYEHYAEYRTCLENTLKELLGDELATSIVFEHSNDGSGIGAALLAASNSMYLEDKS

SEQ ID NO: 16903 - protein, 219 aa, Tropheryma whipplei TW08/27
MKIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRS

SEQ ID NO: 16904 - protein, 320 aa, Leuconostoc mesenteroides subsp. mesenteroides ATCC 8293
MSEILTLGEPVVTFASTDLNKGLVDSINYYKFLGGAELNVMIGATRLGHNTEYISQVGADPLGQFTIKEIARYNVGNHYIATDEGNWTAFQLKELVDQGDPSTFNFRRNSAAAHFDKSLIDQVDFSDVKIAHLSGIFPAISLQAREAFRYFAEQLIDHGIRTTFDPNLRPALWESREVMIETINDLAKYGEIVLPGIDEGEILIGSRDPETIADFYLNNSDRTQTVVVKIGSDGAYVKNKSGESYIVNGFKVEKVVDTVGAGDGFALGLITGLIEGLTMADAVRRGNAVGALQVQTPGDNDGYPTQEELEAFLADNKKEA

SEQ ID NO: 16905 - protein, 448 aa, Escherichia coli
MEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 16906 - protein, 538 aa, Phanerochaete chrysosporium
MLVSVDALALRTLVYELTYLLYPAVPTAAALILLQRFGNVWLPTWTIVLLSLCNVPVAHRILVWLKDGRRWPGSIDLLRQLTQTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCTTGASRTEDFARAFAEAQDAVSFRLRMGWLWPDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 16907 - protein, 367 aa, Haemophilus influenzae Rd
MNDYNSHILQWKKTIMTITTLSRQNIQALTPYQSARKLGGNGTIWLNANEYPTSPEFQLSGKDLNRYPEPQPQRVVQAYANYAGVSTENVLVTRGGDEGIELIIHTFCEPKQDAILFCPPTYGMYAVSAETAGVLSKTVPLTDDFQLNLPEIKNHLNDVKVVFVCSPNNPTGNLLKQSDILDLLQITAGKAIVVVDEAYIEFCPEASVINLLKNYPHLAIIRTLSKAFALAGLRCGFVLANPELIDILSKVIAPYPIPVPSADLAEQALRPSNIATVQALTQELLSNRQWLAKALLVLHQVEKVYESEANYLLIKCQNGQAVFKALWEQGIILRDQNKTLHLQNCIRITVGTRNECEKVVEAIKEVK

SEQ ID NO: 16908 - protein, 259 aa, Triticum aestivum
  unsure (1)..(259): unsure at all Xaa locations
MLPFQLGLNSIKXTLTVRAPLGTIADVVDLGAMGVVVGQDVSTWLAAHPPVAAFGAPAALLYGAGVSVYAFEGVCMVLPLEAEAADKKKFGATLGLSMAFIAVMYGLFGVMGYVAFGDATRDIITTNLGSGWLSAAVQLGLCINLFFTMPVMMNPVYEVAERLFHGKRYCWWMRWVLVVTVGLAAMLVPNFTDFLSLVGSSVCVLLGFVLPATLHIKVFGAEKGWVGVLSDVLLVVLGLVLAVFGTYSSLVQIFHSSSA

SEQ ID NO: 16909 - protein, 107 aa, Zea mays
AGMAYGLSWDLVQWIATSDVARNHSVGTEDMLTGLWLRIGGKGKNRFNAKPAIHDYLNPVPVDQCEHEFMPTTIGVHRLKSNPRWAEALKYFNFTAGLQPSKFYKID

SEQ ID NO: 16910 - protein, 288 aa, Schedonorus pratensis
MGKPAALIPVLALLACLAFGLVSGGNFNDDCDATWEPQNCWVYDAGNSLSLALVSNSSGSMIRSKRQFIFGTVSTWIQASSRATLARHRHNILPILGGDNHDEIDFEFLGNETGQPYTLHTNVYADGVGNKEMQFVPWFDPTGGYHKYTISWTPCMIVWYVDDLPIRVFRNYRQSNGVAFPTSRPMYAYSSIWSADDWATQGGRVKTDWTHAPFVANYHGIDLDICECYGGDCIYGCAGAYGQPYCGGLTDEQRWKMQWVQERYRIYDYCVDYKDGKVPGVECSLPQY

SEQ ID NO: 16911 - protein, 307 aa, Escherichia coli K12
MGSTRKGMLNVLIAAVLWGSSGVCAQYIMEQSQMSSQFLTMTRLIFAGLILLTLSFVHGDKIFSIINNHKDAISLLIFSVVGALTVQLTFLLTIEKSNAATATVLQFLSPTIIVAWFSLVRKSRPGILVFCAILTSLVGTFLLVTHGNPTSLSISPAALFWGIASAFAAAFYTTYPSTLIARYGTLPVVGWSMLIGGLILLPFYARQGTNFVVNGSLILAFFYLVVIGTSLTFSLYLKGAQLIGGPKASILSCAEPLSSALLSLLLLGITFTLPDWLGTLLILSSVILISMDSRRRARKINRPARHK

SEQ ID NO: 16912 - protein, 599 aa, Oryza sativa
MKITALLVLKPSSSGGGASSSGGGGGSGGPEAVVLANATDVSHFGFFQRGAAREFIVFVARTVAQRTQPGQRQSVQHEVIRRIQFAVVNERSCKQVVLIFAEYKVHSHNRNGLCAVAFMDDHYPVRSAFSLLNKVLDEYQKAFGDSWKAATKDATDAAQQWPFLTDALTKFQDPAEADKLMKIQRDLDETKIILHKTIESVLQRGERLDSLVEKSSDLSAASQMKTPEADRYCLVLHRPEQPESEARRSEGKSARQSKQTRRTARGAVAEESGAEMDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTNSVLPEEPELKSTTIIYRFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 16913 - protein, 127 aa, Synechocystis sp. WH 8501
MNDLAKNIKKLDNKLSKRPIALDPGGYFIIYIDRENSLICTKYFTNIINEKGLAVDPETGEVIAARGQKNRTEETLFTGRSAKELCVKVIEENPNCAITMLDHAAYLGREFMRAEIALIQGTEYIQD

SEQ ID NO: 16914 - protein, 176 aa, Triticum aestivum
  unsure (1)..(176): unsure at all Xaa locations
MAPTVMASSATSVAPXQGLKSTAGLPVSRRSNGASLGSVSNGXGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 16915 - protein, 484 aa, Glycine max
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 16916 - protein, 371 aa, ASPERGILLUS NIDULANS FGSC A4
MYLLPEPAVGQLLRDLTRPQCLSFLRTLDTALLTVSAQSFSPPEERLVHQPLRTAITTKDNNLSLFMPVSNTSSTGIKIVTASQSHGIIGVINIFSPKGELLGLLSAAEITAFRTALTVMSLFVRVTSSGAAAGIQRERIVILGSGRQAEWHARLALLLCPGDIRRMTFVNRGRKRLEELERGVISNLKNRYPDVEFTTLSKEGNDHYEEHLCTELALSDVIFSCTPSTEPNFPYSYLAGGTGAGAGSERYKAKFISLIGSYRPHMQEIDTETLLSGGGTVYVDSREACLEESGELIKAGMKGDQLVELGELYQGQELGENKDEGPQPFKMAEGQNVVMKCVGMGIMDLVTGRKLLELGRERNIGVEVNGF

SEQ ID NO: 16917 - protein, 349 aa, Dechloromonas sp. RCB
MRMDTLFLLAVATGVIVLVFDYTNGFHDAANIVATVIASRAMTPAQAVLIVGVFEFLGPLLGGTAVANTIGTFVALDGVVPILSLSILLCGLIGAIVWNLGTWYFGIPSSSSHALVGGLIGAVVVSVGSEHVVWGFAELANGHLTGIVKVLAALLLSPLLGFWLGFLTHRLLTALLLAANPAANARLRGLQYLTAAGLAFSHGANDAQKSMGILTLVLLLGGFIPTFEVPLWVMIACATSITLGIMSGGWRIVRTLGFAIYRVRPIHALGSQLTSSAVILAASVAGAPVSTTHVVATSIMGIGASERPRAVRWAKAKDIATTWLITIPGAAIVAIQAYALVHLFLGGPP

SEQ ID NO: 16918 - protein, 760 aa, Zea mays
  unsure (1)..(760): unsure at all Xaa locations
MWRLRIAEGGGDPWLRTKNAHVGRQVWEFDAAADPDPAVDAARRAFVATRGHLKHSADLLMRIQFAKENSIELHLPGIKLGEHEDVTEEAVLTTLKRAISRFSTLQAHDGHWPGDYGGPMFLMPGLIITLYVTGALNTVLSLEHQKEIRRYLYNHQNEDGGWGLHIEGPSTMFGSALTYVILRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGXPVNKVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSHDGEFPQQEIIGVFNKNCMISYSQYRNIFPIWALGEYRCRVLGAGKSWR

SEQ ID NO: 16919 - protein, 630 aa, Oryza sativa
MESAVGPHFSGLRLDSRRLSSSSLPTSPSAASSNGCGGNDAPAAVNGFAPPPPPSAAAAAEEGSKQPFVIGVSGGTASGKTTVCDMIIQQLHDHRVVLVNQDSFYRGLTEEESDRVQDYNFDHPDAFDTEQLLECMGQLKRSTYMGVDFCKKLCGVSIIRSGESMENALRACCKGIKIGKILIHRDGDNGQQLIYHKFPLDIAERHVLLMDPVLGTGNSANQAIELLISSGVPEERIMFLNLISAPEGVHCVCKRFPRLKIVTSEIETGLNEEYRVIPGEQQQEAKNMACKVRGDMGKLIPVISFFLGAALTAAFVIATMDINWRLSALASWNNNDSPPAVTDEMKALSELTEVLRNASMDDRTVIMTSINRAYAAPGSLLDLFLESFRLGEGTEPLLKHVLIVAMDPAALARCRQVHPHCYLLRRPEGAVDYSDEKRFMSKDYLDMMWGRNLFQQTILQLGFNFLFTDIDIMWFRNPLRHIAITSDIAVANDYYNGDPESLRNRPNGGFLYVRAARRTVDFYRRWRDARRRFPPGTNEQHVLERAQAELSRRADVRMQFLDTAHCGGFCQLSRDMARVCTLHANCCTGLANKVHDLAAVLRDWRNYTAAPPAARRRGGFGWTTPGKCIR

SEQ ID NO: 16920 - protein, 94 aa, Gibberella zeae
TAGSWFCLDVAFYGLSLNNGTILKVIGYSTKDATNVYEFLHNTAVGNIIIVLAGAVPGYWVSVATIDTLGRKTIQLGGFIILTILFIVMGFAYN

SEQ ID NO: 16921 - protein, 204 aa, Oryza sativa (indica cultivar-group)
MDQSFGNLGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGGHGGSGGGAGSARLLLA

SEQ ID NO: 16922 - protein, 217 aa, Glycine max; identical to SEQ ID NO: 7160

SEQ ID NO: 16923 - protein, 570 aa, ASPERGILLUS NIDULANS FGSC A4
MSLPGKALAVSDTHGYRDVSHDPVTSALPNGDVPVFDDSMDADERVITALGYKQEFKREFSLWTTFCVSFAVLGLLPSFASTMYYGMGYAGTAGMVWGWIIAMIFIQCVAMSMAELCSAMPTSGGLYYAAAVLAPPGYGPFAAWITGWSNWIGQITAAPSVDYALAAMILAAGSIQNPDYIPTQWQTYLLTVFILIVHTGISSMPTKWVAVFNSWGSTFNMLALVAVIIAIPAGTTNSPKFTPSREVWGNITNMTDYPDGVAVLMTFVAVIWTMSGYDSPFHLSEECSNANIASPRAIVITSGVGGLMGWFLQLVVAYTVVDIDAVLNSDLGQPWASYLFQVMSRKGALAILALTIVCGFSMGQGCMVAASRVTYAYARDDCFPFSKHWKRINNTTQTPVNAVILNTVLGILMCLLLFAGDVAIGALFSIGAIAQFVAFIIPIAIRVFFVGDRFRKGPWHLGSFGPWIGALGVGFVLLMVPILCLPADTGSDLTPDLMNWTCLVWGGPMIAVSIWWIFDAHKWFKGPKVNLEHVIHGNIIDGIDGSQEQTTVVPGAGAPADVSHRSSPKL

SEQ ID NO: 16924 - protein, 259 aa, Triticum aestivum
  unsure (1)..(259): unsure at all Xaa locations
PREAGPSRSCAGGVAADYRGQGGVARQFEPGLIPDIKGAVNIPWMAXARIGHLXKAQIPEGIGVDYXDESEVLTLAEDGQHINQHNFRVPFVCGFRDLGEALRRIREGAGKIHNKGEAGHGNVVEAVRHVRFVMGAVRPLRNMDEDEVFNFAKQIAAPFDLVMQTKQLGRLPVVQFPPGGVAPPADPPLMMQLGFDGVFVGFGIFKNGDPARCARAIVQAVTPFNDPEILANVNAGLGEAMVGINLFDPNVERFPPRFQ

SEQ ID NO: 16925 - protein, 352 aa, Emericella nidulans
MSVPEVQWAQVVEKAGTPPVYKQVPVPKPGPDEILVKMRYSGVCHTDLHAMKGDWPLPSKMPLIGGHEGAGVVVAKGELVKDEDFKIGDRAGIKWLNGSCLSCEMCMQADEPLCPHASLSGYTVDGTFQQYTIGKAALASKIPDNVPLDAAAPILCAGITVYKGLKESGARPGQTVAIVGAGGGLGSLAQQYAKAMGLRTIAIDSGDEKKAMCEQLGAEVFIDFSKSADVVADVKAATPGGLGAHAVILLAVAEKPFQQATEYVRSHGSVVAIGLPANAFLKAPVFTTVVRMINIKGSYVGNRQDGVEALDFFARGLIKAPFKKAPLQDLPQIFELMGQGKIAGRYVLEIPE

SEQ ID NO: 16926 - protein, 677 aa, Leuconostoc mesenteroides subsp. mesenteroides ATCC 8293
MLKENQSKWSSAGALIAIGIVFGDIGTSPLYTMNSILNSAKSAHNLDTFVIGSVSLVFWTLMLITTIKYVIIALQADNHGEGGIFALYSRVKKPNKKWLLLPALIGGAALLADGTLTPAVTVTTAIEGLKGQGIGEFIFPNNQTIVLFVVTVILLIVFTFQKAGTKKIGKIFGPVMLTWFLFIGFFGLVNIFSDLSILKALSPTYAIAVLFSPENKTGIFILGSVFLATTGAEALYSDMGHVGKHNIYVSWIFVYTMLILNYMGQGAWIMSHANQENLLMQSSNPFFEILPSGWRIFGVVMAALAAIIASQALISGAYTLVSEAINLKVIPRLRTFYPSEARGQMYIGTVNWLLCIIGLIIVWAFQTSHNMEAAYGLSITITMLMTTLLLYQFIKQEMKNKILAFFFVVIFGMIETVFLIASLGKFLHGGYATLIIMVAILSVMMIWFYGNKRREAISQQNDYLSLKDYRKQLINLSKDNEEPIFASNLVYIVNIHQNYMLKRNIIYSILGSKPKRAETYWFVTIRSSNDPYEKSYSVDMLGTNNIVHVTLNIGFKVEPQVNMYMKQIANNLVKQNIIKPQFPKYTLNKRGTVGEFKYIMANQNYEDLLNLPDIHTWDRFIISGRLWLQSHTVKPSSFYGLEVSDVLEETVPLFIKDSNKSKIKLIQNEVKNVIKPE

SEQ ID NO: 16927 - protein, 441 aa, Pseudomonas syringae pv. syringae B728a
MVNRLHGKSLTALLALGAFAPIAQAADAPVLNTGSTAWMVTAAVLVLFMCLPGLALFYGGLVRAKNMLSLFTQCFGIAGVVGVLWVIYGYSMVVDTSNMVEGQVSFNSFVGGLSRAFLAGMTPDSLVGDIPEGVFVTFQMTFAIITPALIAGAFAERMKFSAALLFMALWFTLVYAPVAHMVWGGAGALMHNWGVLDFAGGTAVHINAGVAALAACLVLGKRKGYQNTPMPAHNLSLTMAGAAMLWVGWFGFNIGSGGGLNGTSGIVMLNTQVGACAGILGWMFTEWFKVGKPSALGLASGALAGLVGITPACAYVGVGGALAIGVLCGVFCYLSVTVLKKRLGYDDSLDVFGLHGIGGMIGAILTGVFCVPALGGLVPDVSMGAQVIAQIKGVLFTTAYCFAVSWIILKAVQALIGLRAHESVEEMGLDLAEHNERAYNH

SEQ ID NO: 16928 - protein, 237 aa, Abies firma
YTYNLRNKGPEDVILRVIYCGICHSDLVQMRNEMGMSNYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESLDFIMDTIPVAHPLEPY

SEQ ID NO: 16929 - protein, 294 aa, Glycine max
VIDDVAGAGAESGDLKGETAPVDGLLNWQNARLKAEILTHPLYEQLLSAHVACLRIATPVDQLPRIDAQLAQSQNVVAKYSAFGQAIVGDDKELDQFLSHYVLLLCSFKEQLQQHVRVHAMEAVMACWEIEQSLQSLTGVSPGEGTGATMSDDEDEQVDSDANLFDGALDGPDSMGFGPLIPTENERSLMERVRHELKHELKQGYKDKIVDIREEILRKRPAGKLSGDTTSVLKAWWQSHSKWPYPTEEDKARLVQETGLQLKQINNWFINQRKRNWHSSPSTSTVLKSKRKRS

SEQ ID NO: 16930 - protein, 412 aa, Burkholderia fungorum
MKKIFNDPSNVVKSAPRYCRDGTRRCSDDTEHRACSAGDCFARGDCGAVPGRSMPPRWFVPRVVSPTPLLQPRSNGSPPSGAPLMPSVSYAGLSRPTAPCSTPSSPQSRRSTVASNPVWTHLAPGEWWPSRRLPLYRYFGGSGAMQLPVPMMNIVNGGAHANNSLDIQEFMIVPVSQPSFREALRCGAEVFHALKKILSDRGMSTAVGDEGGFAPNFGSNDECLSTILQAIEKAGYRAGEDVLLALDCAASEFYHDGKYQLAGEGLQLSSTEFADYLANLADKFPIVSIEDGMHESDWAGWKTLTDKLGKKIQLVGDDLFVTNTRILKEGIEKGIANSILIMINQIGTLTGNFRGDRNGQARRLHGCDLASFGRNRRFDDCGYRRRSERRADQDGFAVAFGPHFEVQPVAAH

SEQ ID NO: 16931 - protein, 239 aa, Oryza sativa
  unsure (1)..(239): unsure at all Xaa locations
MAQLQETYACSPATERGRGILLAGDPKTETIAYCTGRSVIIRRLDAPLDCWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANYYEGPPFKFKHSIRDHSNFVNCIRYAPDXXSKFISVSSDKKGXLIYDGKTGDKIGELSSEGSHQGVYM

SEQ ID NO: 16932 - protein, 197 aa, Triticum aestivum
DSDEAEDQYDFDPLDDTKTWPEDLLPLQPVGRLVLDKNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIRKPNDFKQPGERYRSWDADRQERFVRRFADSLGHPKGSQELRSIWIDL

SEQ ID NO: 16933 - protein, 410 aa, Glycine max
MVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 16934 - protein, 121 aa, Oryza sativa
  unsure (1)..(121): unsure at all Xaa locations
MLGIEARGFIFGPAIALAIGAKFIPLRKPKKLPGEVISETYILEYGTDCLEMHVGATEPGERVVVVXDLVATGGTLCAAIKLLERAGADVVECACLIGLPKYKNFYKLNGKPVYILVESRK

SEQ ID NO: 16935 - protein, 339 aa, Shigella flexneri 2a str. 301
MSMIKSYAAKEAGGELEVYEYDPGELKPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLSVPAFTLIAGDRSISGSATGTPYELRKLMRFAARSKVAPTTELFPMSKINDAIQHVRDGKARYRVVLKADF

SEQ ID NO: 16936 - protein, 334 aa, Pseudomonas syringae pv. syringae B728a
MPDDAQQPAQRVMVLYTGGTIGMQASANGLAPASGFEARMAGQLAEHPELVVPQWRFREMSPLIDSANMTPSYWLRLRAAVIEAVEVDGCDAVLVLHGTDTLAYSAAAMCFQLLGFSAPVLFTGSMLPAGVQDSDAWENVNGALLALGSGLVSGVQLYFHGQLMTPVRCAKIRSFGRQPFAPLQRSRGGHAVISLPDALNYRQPKTLTEVAVLPLFPGVGAAQLDGLINSGIRGLVLECFGSGTGPSDDPQFLASLENARALGICVVAITQCHEGGVELDVYEAGSRLRSAGVLSGGGMTREAALGKLHALLGAGLTTEEVRRLVELDLCGELR

SEQ ID NO: 16937 - protein, 237 aa, Bidens pilosa
EREGVTHVFAYPGGASLEIHQDLTCTTLIQNILPRHEQGAIFAAEGYAHASGLPGVCMATSGPGATNLFSGFADALLDSVPIVAITGQVPRRMIWTDAFQETPIVEITRSITKHSYLLLDVDDIPRIVREAFYLANSGRPGPILIDVPKDIQQQLTVPKWDSPMRLAGYVARLPKPPKDNQLRQIIRLVSGSKRPVLYVGGGCLNSGDELRRFVELTGIPVASTLMGLGSYPGSSDL

SEQ ID NO: 16938 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLL

SEQ ID NO: 16939 - protein, 385 aa, Neurospora crassa
MLSRNSMRLARAVAQPTPRLARGFASVQDTPAQTLQSDIFKPTKYGGKYTVTLIPGDGIGAEVAESVKTVFKADNVPITWEQIEVSGVQDNASRTEEAFQQAVASLRRNKLGLKGILHTPISRSGHQSFNVAMRQELDIYASISLVKNLPGLQTRHKDVDLCIIRENTEGEYSGLEHQSVDGVVESLKIITRAKSERITKFAFQFALANQRKKVTCIHKANIMKLADGLFRGTFNRLAKDFPQLECNDMIVDNASMQCVSKPQQFDVMVMPNLYGGILSNIAAALVGGPGVVPGCNMGRDVAVFEPGCRHVGLDIQGKDQANPTALLLSGTMLLRHLGLDDHANRISNAVYDVIAQGKVRTRDMGGEASTHEFTRAILDSMEKSL

SEQ ID NO: 16940 - protein, 175 aa, Capsicum annuum
MGRGKVELKRIDNKINRQVTFAKRRNGLLKKAYELSVLCDAEIALIIFSSRGKLYEFCSSSSMSKTLERYHKHNYGALEGTQPSADSQNNYQEYLKLKTRVEVLQQSQRHMLGEDLGELNTKDLEQLERQLDSSLRQIRSTKTQHMFDQLAELHQKEQSLTEMNKSLKTKVSISP

SEQ ID NO: 16941 - protein, 444 aa, Chloroflexus aurantiacus
MSDDPRTALLHRVEADQVAFINLQFTDVLGIGKTVTIPVEELPDALDHGVWFDGSSIEGFARMVESDMYLVPDISTYAVVPWDQHQGVTTARLICSVYTPDGKPFAGDPRNVLRRMLDQAAAAGYRFMVAPELEFFLFKTDPNGNILEPHDKASYFDISTDLATHIRRQMARTLQAMGIAVEAVHHEVAPGQHEIDLRYADALQSADHLVTARVALKAVAQMNGLHATFMPKPIAGVNGSGMHVHQSLLDRDTGKNLFADPDDPYGLSALARHFIAGLLAHARGMCALLAPLVNSYKRLVPGFEAPVYISWGRTNRSALVRVPRITAGRYQATRIELRCPDPACNPYLAYTAMLAAGLDGIRRKLPLRDATEEDLFHVDPRARGLTTLPTSLGSALDALREDEVILEAIGPSIAERFLDARQQEWESYRAYVSQWEIERYLAIF

SEQ ID NO: 16942 - protein, 327 aa, Pseudomonas putida KT2440
MQLGIIGLGRMGGNIARRLMRAGHRTVVHDRNRDAITGLEGEGAQGAHDLGALVQKLKAPRAVWVMLPAGDATEQTIAQLAEMLEPGDAIIDGGNTFYKDDMRRAAELAKRGLHYLDVGTSGGVWGLDRGYCMMIGGEKDVFERLEPLFKALAPGVGDIPRTHGRSGEHQRAEHGYIHAGPPGAGHYVKMVHNGIEYGLMQAYAEGFDLLRSKGGNELPEDQRFDLNVAEIAEVWRRGSVVTSWLLDLTADALVADPQLSQFSGSVSDSGEGRWTIDAAVEQAVPVPVLSSALFARFRSRQQQGTYGDKILSAMRLGFGGHVEKKGE

SEQ ID NO: 16943 - protein, 431 aa, Clostridium tetani E88
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 16944 - protein, 426 aa, Pseudomonas aeruginosa UCBPP-PA14
MNGVVRGKRIERNSLPKVFEKGINLPASLFALDITGSTVESTGLGLDIGDADRICYPIPGTLSMEPWQKRPTAQLLMTMHELEGDPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTGEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNQVEPGAPIEGNSYEQLEPSLPNNLRDALRELDDSEILAKYIDPKYIDIFVACKESELEEFEYSISDLEYNWYLHTV

SEQ ID NO: 16945 - protein, 285 aa, Bacillus cereus ATCC 14579
MPLVSMKEMLNKALEGKYAVGQFNMNNLEWTQAILAAAEEEKSPVILGVSEGAARHMTGFKTVVAMVKALIEEMNITVPVAIHLDHGSSFEKCKEAIDAGFTSVMIDASHHPFEENVETTKQVVEYAHARNVSVEAELGTVGGQEDDVIAEGVIYADPAECKHLVEATGIDCLAPALGSVHGPYKGEPNLGFAEMEQVRDFTGVPLVLHGGTGIPTADIEKAISLGTSKINVNTENQIEFTKAVREVLNKDQEVYDPRKFIGPGRDAIKATVIGKIREFGSNGKA

SEQ ID NO: 16946 - protein, 204 aa, Zea mays
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGCLISFQKQPKKNPNPFPFPMAGFT

SEQ ID NO: 16947 - protein, 505 aa, Solanum melongena
MDVPCPWYSLLIPLFVFIFLLIHHCFFTTSKKQNMLLLPSPRKLPIIGNLHQLGSLPHRSLHKLSQKYGPVMLLHFGSKPVIVASSVDAARDIMKTHDVVWASRPKSSIVDRLSYGSKDVGFSPFGEYWRRAKSITVLHLLSNTRVQSYRNVRAEETANMIGKIRQGCDSSVINLGEHLCSLTNNIISRVALGRTYDEKESGIEHIIEQFVELLGIFNVGDYIPRLEWVNKFTGLDAKVKKVAKELDMFLEIVIEEHIIRKKKEEYTSTGEAKDFVDVLLEIQNGNETDFPLQRDSLKAILLDSFAAGTDTTFATLDWTMAELLRQPRALKTLQDEVRGLAQGKSEITEDDLKNMQYLRAVIKESLRLHPTQESLLVPRESMEDVNLLGYYHIPARTQAIINAWAIGRDPLSWENPEEYQPERFLNSDADVKGLNFKLLPFGAGRRGCPGSSFAIAVIELALARLVHKFDFALPEGIKPEDLDMTETIGITTRRKLPLLVVATPC

SEQ ID NO: 16948 - protein, 252 aa, Gnetum parvifolium
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 16949 - protein, 303 aa, Rhodobacter sphaeroides
MSIEIIGPEAEAHLSWDGLTTALTQGHKLPRAEVADIFLYRGKDTVLSRAAWIDGLGQLVKTATIFPGNGAAGKPTVNGAVTLYSDRDGTLEALVDFHLVTKWKTAGDSLLAAKRLARRDSREILLVGAGNVARSMIEAYGSHFPDARFTVWNRSADKARAMEGPQVRATEDLEAAVRAADIICTATMSQEPVVKGEWLKPGTHLDLIGAYRPDMREVDDEALRRATVFVDSRKTTIGHIGEIQDPLDRGILTEADIRADYYDLASGLYARRSDEEITLAKNGGGAHLDLMTASYIAAMWRQR

SEQ ID NO: 16950 - protein, 212 aa, Triticum aestivum
  unsure (1)..(212): unsure at all Xaa locations
KPYVLPVPFMNVLNGGSHAGGRLAFQEFMIVPSSAPSFSEALRQGAEVYQILKGLAKKKYGQSAGNVGDEGGVAPDIQTAEEALDLITDAIEAAGYTGKMFIAMDVASSEFYKEDAKKYDLDFKNPESDPTKWLTYVELXDKYQTLXKTYPIGKNXDSFAEDDREPGASLQSHSAFRRGRAALACYKSLSYSDTAPGAMALPSPCARRETGG

SEQ ID NO: 16951 - protein, 223 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPVTRNVLSHLETYEQCQIIVAFLVYPWTLISKLPLHLVPLTGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 16952 - protein, 182 aa, Magnetospirillum magnetotacticum
MARRGWTVADIPSQAGRRAVVTGASAGLGYETALALAGAGAAVVLAVRDAAKGARAAEAIARAHPGADLAVRLIDTASLASVRAFAADWPARQPIDRLILNAGIAAVPSREESVDGFERQLATNTLGHVALTGLLLPVLSPTAGSSRWRASPIAAAGSASTTSTGARVTGRRPPTVRASSRS

SEQ ID NO: 16953 - protein, 719 aa, Pneumocystis carinii
MIYGYTEKELEKTDPDGWRLIVEDTGRQRWKYLKTEEERRERPQTYMEKYFLGKNMDLPEQPAAKTPIESARKGFSFYKHLQTSDGNWACEYGGVMFLLPGLIIAMYISKIEFPDEMRIEVIRYLVNHANPEDGGWGIHIEGKSTVFGTALNYVVLRILGLGPDHPVTMKARIRLNELGGAIGCPQWGKFWLAVLNCYGWEGINPILPEFWMLPEWLPIHPSRWWVHTRAVYLPMGYIYGEKFTAPVDPLIESLREELYTQPYSSINFSKHRNTTSPVDVYVPHTRFLRVINSILTFYHTIFRFSWIKDMASKYAYKLIEYENKNTDFLCIGPVNFSIHILAVYWKEGPDSYAFKSHKERMADFLWISKKGMMMNGTNGVQLWDTSFAVQALVESGLAEDPEFKDHMIKALDFLDKCQIQKNCDDQQKCYRHRRKGAWPFSTRQQGYTVSDCTAEALKAVLLLQNLKSFPKRVSYDRLKDSVDVILSLQNKDGGFASYELIRGPSWLEFINPAEVFGDIMIEHSYPECTTAAVTALCYFRSLCSHYRGPEINKSVKNAIQFIKESQRPDGSWYESWAICFTYATMFALESLSCVKDFYENSFHSRRACDFLVNKQEEDGGWSEGYQSCTDGIWTRHPTGSQVVQTAWACIGLMYANYPDETPIKRGINLIMSRQQPNGEWKQEAIEGVFNKNCMISYPNYKFNFTIKALGMYSKRYGNI

SEQ ID NO: 16954 - protein, 108 aa, Glycine max
  unsure (1)..(108): unsure at all Xaa locations
PTRTATTETTEXXHENRKGTKQKEXKPKXDKDESKTNNQEPKAGERRGGRGGNNGKTQTXXXRANREGTAGATKDKRQQAKXXGTRTQAAESRGGARQGEESHPEGRA

SEQ ID NO: 16955 - protein, 321 aa, Brassica napus
MEKNIKFPVIDLSKLNGEERDQTMALIDDACQNWGFFELLNHGIPYDLMDNIERMTKEHYKQFMEHKFKEMLRSKGLDTLETEVEDIDWESTFFLHHLPQTNLYDIPNMSEQYRTAMKDFGKRLEKLAEELLDLLCENLGLEKGYLKKVFRGTKGPTFGTKVSNYPPCPNPEMIKGLRAHTDAGGLILLFQDDKVSGLQLLKDGDWVDVPPLKHSIVINLGDQLEVITNGWYKSIMHRVMTQKEGNRMSIASFYNPGSDAEISPAHSLVDKESEYPSFVFDDYMKLYSGVKFQPKEPRFEAMKNAAAVTTDVNPVATEETF

SEQ ID NO: 16956 - protein, 372 aa, Chlamydomonas reinhardtii [sequence omitted]

SEQ ID NO: 16957 - protein, 353 aa, Oculimacula yallundae
MCFGGRDDGEAKRSREIDALIHRDEKVMQKVVKLLLLGAGESGKSTILKQMRLIYTKDGFTKNEKEEWRVIIFNNILDGLRMTLDAMEEFGIPFEFKNTDVHLPVILADKDLRPYEPIPVEYLRAFKDMWKDQGIQKAIKRGNEFALHDNLSYFFQDLDRLFNKEFVPTDQDVLRARLRTTGITETVFDLGSLQYRMFDVGGQRSERKKWIHCFENVNALMFLVAISGYDQCLAEDKDGNQMQEALMLWESIANSHWFKNSALILFLNKMDLFKEKIAISPITKFGFSDFQGDPRDPQQASKYFMDKFVALNRSPVREVYSHFTNATDTDLLKVTMASVQDMIIQKNLQKLIL

SEQ ID NO: 16958 - protein, 128 aa, Triticum aestivum
MEEVEVPSYFVCPITLDVMRDPVTLPTSITYDRHAIHRWLRLAASCPLTKLPVLPDCEPTPNHTLSRLIRSWCALHRPDDAVDRTMNSAPADRARLAALVSRLADAKNKGPAREALAALRELKDVAAE

SEQ ID NO: 16959 - protein, 196 aa, Mitthyridium sp. Mishler 11-12/1998
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFTTDSHSSIFDAMAGIALSDTFVKL

SEQ ID NO: 16960 - protein, 381 aa, Oryza sativa
MELDAPPPPAAVAAAAATAGISEKVLQKKEEGGGDPVTGHIISTTIGGKNGEPKRTISYMAERVVGTGSFGIVFQAKCLETGETVAIKKVLQDRRYKNRELQLMRAMEHPNVICLKHCFFSTTSRDELFLNLVMEYVPETLYRVLKHYSNANQRMPLIYVKLYIYQLFRGLAYIHTVPGVCHRDVKPQNVLVDPLTHQVKLCDFGSAKVLVPGEPNISYICSRYYRAPELIFGATEYTTSIDIWSAGCVLAELLLGQVLGTPTREEIRCMNPNYTEFKFPQIKAHPWHKIFHKRMPPEAIDLASRLLQYSPSLRCTALDACAHSFFDELREPNARLPNGRPFPPLFNFKHELASASPELIHRLIPDHIRRQHGLNFAHAGS

SEQ ID NO: 16961 - protein, 382 aa, Arabidopsis thaliana
MSSDQLSKFLDRNKMEDNKRKVLDEEAKASLDIWKYVFGFADIAAAKCAIDLKIPEAIENHPSSQPVTLAELSSAVSASPSHLRRIMRFLVHQGIFKEIPTKDGLATGYVNTPLSRRLMITRRDGKSLAPFVLFETTPEMLAPWLRLSSVVSSPVNGSTPPPFDAVHGKDVWSFAQDNPFLSDMINEAMACDARRVVPRVAGACHGLFDGVTTMVDVGGGTGETMGMLVKEFPWIKGFNFDLPHVIEVAEVLDGVENVEGDMFDSIPACDAIFIKWVLHDWGDKDCIKILKNCKEAVPPNIGKVLIVESVIGENKKTMIVDERDEKLEHVRLMLDMVMMAHTSTGKERTLKEWDFVLKEAGFARYEVRDIDDVQSLIIAYRS

SEQ ID NO: 16962 - protein, 247 aa, Zea mays
RERESASDLGQSVSVLGVSFSYPRPRRWVCAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSWASDFGLMKIDDPGRVISFSEKPKGDELKAMQVDTTLLGLSKEEAENKPYIASMGIYIFKKDILLNLLRYVNSTYWSSQSFIKISM

SEQ ID NO: 16963 - protein, 498 aa, Chlamydomonas reinhardtii
MADEMDPMTACITALTDAAMTTAQATALCGQFAFAADNSDLSDRLDQTNQGLNTLYLVSCGALVFVMHAGFAMLCAGAIRSKNTMNILLQTVMDAAVSAVAFYILGYGFAYGIGNNPNGFIGDSLFGLSRWVSHSSSSDAGANWQAWFFQWAFAATATTIPAGAVAERLNFNAYLIYSFFISAFVYPVVVHWVWAAEGWLGYARFGGYSHLFRSGMIDFAGSGVVHMTGGLAGLAGCIMVGPRMGRFDSNGQPVEMPGHSATLVVLGTVLLWFGWYGFNPGSQLIINYTASAAVVGRAAVTTTLSGAAGCLSCLLTAFLRHKAWDLVSGCNGALVGFVSITASANVVEPWAALIAGLVGGWVFDAVCLLFLKLRIDDPLSAAPMHAFCGAWGVFFAGLLAKKEYICESYGRDCEGYVADGLFYVGDGRLLAQVIGIISIFAWVFGLMLLLFGGLKAVGLLRISAEEEQAGLDVSKHGGSAYNYDHGLGKPEKAQALGL

SEQ ID NO: 16964 - protein, 433 aa, Brucella suis 1330
MLITGRNKQTALVASLPALFALAGTAMAQDTAPAPTLDTGDTAWMLTSTALVLMMTIPGLALFYGGMVRKKNVLSTVMQSFAITCLMSILWMIAGYSLAFTDGGSLHSYIGGFSKVFFSGVTMESLTGTIPEYLFITFQMTFAIITPALITGSFAERMKFSSMLVFLTLWLFIVYVPVAHWVWGGGFMASDGVLDFAGGTVVHINAGVAGLVAALVIGKRDGYGHTNMAPHNLVLSVIGAALLWVGWFGFNAGSAAGANALAGVAMLNTQVATAGAALAWMFVEWAISGKPSVLGIISGAVAGLVAVTPAAGFVNPTGALIIGIVAGAVCYVAAVKIKHVLGYDDSLDAFGVHGVGGFVGAVLTGFFADATINPASEGATIGKQFFGAAITIIYTAIATVIILYVVKAIMGLRPGKQAEIEGLDIALHGEAVQ

SEQ ID NO: 16965 - protein, 506 aa, Rhodospirillum rubrum
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWKFPILMATWKLAPALAAGNCIVLKPAEQTPISILVLTELIADLLPPGVLNVVNGFGLEAGKPLASSKRIAKIAFTGETATARLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 16966 - protein, 824 aa, Magnetococcus sp. MC-1
MEVSDQSSRPEHDFKCQGTLLQAIHRHVVTTLGNDVFPPRKETYYKGLAYAVRDRLMERWVMAQRDFYDQKAKRVYYLSMEYLPGRFLMNYITNLELEQEVEAAIKDMPFTLQALEEEEWDAGLGNGGLGRLASCFMDSMATLKIPGYGYGLRYDYGIFFQKIVNGYQVEKSDNWIRNGFPWEIKRTGFLYDVNFYGRSQAYIDSVGETRYRWVDTQQVHAMACDIMIPGYGTKHVNNMRLWESVSDEAFSLTHFNDGDYTGAMQAKVREESITKVLYPSDEKAEGRELRLKQQYFMVAATLHDIFRRFKKKHGQEFQKLPDQVAIQLNDTHPSIAVAEFMRRLLDEEMVGWDQAWEIAVKTFAYTNHTVLPEALETWPVELLGRLLPRHLEIIYEINHRFLEMLRQDFPHRPDLQNKLSIIKEGPTRLVRMAHLAIIGSHAVNGVAELHSRIIRESLFRDFNTIYPDRLTNVTNGITPRRWLRQANPELSQLISQAIGDAWIADLDQLKRLIPLADDAAFQQQWIAVKRIKKQQLSAYIQRKLKFSPNPDALFDVQVKRIHEYKRQLLTIMHGIALYRRLLINPQLDMVPRTIILAGKAAPAYHLAKNIIKLANAVAEQINNNPICQGKLSMAFLPNYCISQAEKVIPGADLSEQISTAGMEASGTGNMKFALNGALTIGTLDGANVEIMEEVGAENIFIFGLTSEEVEQWREGGLYNPRWYVERDEELRGVLQMISSDTFCPGQPGLFEPIRASLLERGDYYMVIADFRAYLDRQQEVAETYRNTGEWARRSILNTANMGKFSSDRAIREYARNIWDVEPLR

SEQ ID NO: 16967 - protein, 398 aa, Archaeoglobus fulgidus DSM 4304
MGDSEIQYLLEKLKKLEEDYYKLRELYRRLEDEKKFIESERIRYEREVRRLRSEVERLRSPPLLVGVVSDILEDGRVVVKSSTGPKFVVNTSQYINEEELKPGARVALNQQTLAIVNVLPTSKDPMVYGFEVEEKPEVSYEDIGGLDVQIEEIREAVELPLLKPELFAEVGIEPPKGVLLYGPPGTGKTLLAKAVANQTRATFIRVVGSEFVQKYIGEGARLVREVFQLAKEKAPSIIFIDELDAIAARRTNSDTSGDREVQRTMMQLLAELDGFDPRGDVKVIGATNRIDILDPAILRPGRFDRIIEVPLPTFEGRIQIFKIHTRKMKLAEDVDFKELARITEGASGADIKAICTEAGMFAIREERAKVTMLDFTKAIEKVLKKTTPIPDLKGVMFV

SEQ ID NO: 16968 - protein, 762 aa, Zea mays
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNEDGGWGTLILGSSTMFGTCSNYITLRLLGEEPYANNSVLAKGRAWILSHGGATLIPQWGKIWLSVLGLFDWSGNNPIFPELWSIPQFLPFHPGKFWCFARMVYLPMAYLYGKKFVGPITPTILALREEIYDTPYGKIDWSDARSKCAKEDLICPRTLLQNVIWTSLYRCVEPVLSSWPINKLRERALGNIMEHIHYEDENTQYLCICPVNKALNMVCCWVEDPNSDAFKRHLARIPDFLWISEDGMKAQVYDGCQSWETSFIIQAFCATDLVNDYGSTLQRAYEFMKNSQVMRNHPGDQRYWHRHRSKGSWTLSSADNGWAVSDTTGEALKAVLLLSKISNKNNLVGDPIERERLHDAIDCLLSFANKDGTFSTYECKRTYSWLEILSPCETFPNIVVDYPYPECTSSVLQALILFKDLYPGYRTEEIEALVRSAATFIETKQQEDGSWLGNWGICFTYGAFFSIKGLVASGRTYKNSPCIRKACHFILSKQLSTGGWGESHIAIETQVYVNLKGDRAHAVNTAWAMLALIYAGQFERDPTPLHRAAKELINMQLETGEFPQQEHVGCFNCSLYFNYPSYRNLFPIWALGEYHRGLRAKKDK

SEQ ID NO: 16969 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 16970 - protein, 778 aa, Fusobacterium nucleatum subsp. vincentii ATCC 49256
MEERLLEKFSVSLKDTTPFEVYRALGETVMSFIAKDWYKTKQEYSKTKQAFYLSSEFLMGRALGNNLINLGIDKEVKEFLEELGIDYNQVEDEEEDAALGNGGLGRLAACFMDSLATLNLPGQGYSIRYRNGIFNQYLRDGYQVEKPETWLKYGDVWSVMRPEDEVVVNFGHTSVRALPYDMPIIGYGTNNVNTLRLWEAHSIVDLDLGVFNQQDYLHATQDKTLAEDISRVLYPNDSTDEGKKLRLRQQYFFVSASLQDIIKKFKKIHGREFLKIPEFIAIQLNDTHPVIAIPELMRILVDIEGVLWEDAWEIVKKTFSYTNHTILAEALEKWWVGLYQEVVPRIFQITEGIHNQFKNELATLYPDDVDKQNRMQIIQGNMIHMAWLAIYGSHKVNGVAELHTEILKEHELRDWYELYPEKFLNKTNGITQRRWLLKSNPQLASYITELIGDAWIKDLSELKKLEQFLDNEKVLNKIWDIKIEKKKELIEYLRETQGIDINPKSIFDVQVKRMHEYKRQLLNIFQVYDLYQQLKQNPSMDFTPTTYIYGAKAAPGYKVAKGIIRLINDIAQIINGDSDVKDKLKVVFIENYRVTVAEKIFPAADISEQISTAGKEASGTGNMKFMLNGAITLGTLDGANVEIVKEAGEENEYIFGMRVKDIDELRKKGYDPRFPYNNITGLKQVVDALIDGSLSDLGSGIYREIHSLLMERGDQYFVLEDFEDYRRKQREINRDYKNKISWAKKMLKNIANAGKFSSDRTILEYANEIWDIKETKIK

SEQ ID NO: 16971 - protein, 387 aa, Corynebacterium glutamicum ATCC 13032
MSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 16972 - protein, 474 aa, Yersinia pestis CO92
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGNAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 16973 - protein, 844 aa, Synechococcus sp. PCC 7942
MSDSTAQLSYDPTTSYLEPSGLVCEDERTSVTPETLKRAYEAHLYYSQGKTSAIATLRDHYMALAYMVRDRLLQRWLASLSTYQQQHVKVVCYLSAEFLMGRHLENCLINLHLHDRVQQVLDELGLDFEQLLEKEEEPGLGNGGLGRLAACFLDSMATLDIPAVGYGIRYEFGIFHQELHNGWQIEIPDNWLRFGNPWELERREQAVEIKLGGHTEAYHDARGRYCVSWIPDRVIRAIPYDTPVPGYDTNNVSMLRLWKAEGTTELNLEAFNSGNYDDAVADKMSSETISKVLYPNDNTPQGRELRLEQQYFFVSASLQDIIRRHLMNHGHLERLHEAIAVQLNDTHPSVAVPELMRLLIDEHHLTWDNAWTITQRTFAYTNHTLLPEALERWPVGMFQRTLPRLMEIIYEINWRFLANVRAWYPGDDTRARRLSLIEEGAEPQVRMAHLACVGSHAINGVAALHTQLLKQETLRDFYELWPEKFFNMTNGVTPRRWLLQSNPRLANLISDRIGNDWIHDLRQLRRLEDSVNDREFLQRWAEVKHQNKVDLSRYIYQQTRIEVDPHSLFDVQVKRIHEYKRQLLAVMHIVTLYNWLKHNPQLNLVPRTFIFAGKAAPGYYRAKQIVKLINAVGSIINHDPDVQGRLKVVFLPNFNVSLGQRIYPAADLSEQISTAGKEASGTGNMKFTMNGALTIGTYDGANIEIREEVGPENFFLFGLRAEDIARRQSRGYRPVEFWSSNAELRAVLDRFSSGHFTPDQPNLFQDLVSDLLQRDEYMLMADYQSYIDCQREAAAAYRDSDRWWRMSLLNTARSGKFSSDRTIADYSEQIWEVKPVPVSLSTSF

SEQ ID NO: 16974 - protein, 163 aa, Zea mays
MISTKRIAQLAKKWQRMEALGRKRRLAWGTAAAAKKADRCCASVASKGHCAVYTTDGARFEVPLACLGTEVFAELLHMSREEFGFAGGHGRILLPCDAAIMEYAMCLLRRGASAELEQAFLSTVAMSCHCASQMAPCRALFGRASALQRRCRCRAHGELTPGS

SEQ ID NO: 16975 - protein, 305 aa, Glycine max; identical to SEQ ID NO: 15791

SEQ ID NO: 16976 - protein, 482 aa, Thermoactinomyces vulgaris
MKKGALLSGLVCLLSAVLMFASTAPTAVALSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRTIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 16977 - protein, 482 aa, Triticum aestivum
  unsure (1)..(482): unsure at all Xaa locations
PLPSSHLTSAPVLSSSLPPEAAASLLSARIAMAAAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEXLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 16978 - protein, 425 aa, Xylella fastidiosa Temecula1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 16979 - protein, 80 aa, Zea mays
DWAVTLKYVGVIRGRFTHSRQGNLTRGPLPELDGLHPAPELMDDQLGNINQKGFLTLNSQPAVTVVKCDSAIAGRGGPGG

SEQ ID NO: 16980 - protein, 449 aa, Zea mays
  unsure (1)..(449): unsure at all Xaa locations
LQVPVRNSRVVPRVRDSXIILGGGTGSQHFPLTRTRATPAVPVGGCYRLIXIPMSNXXNSGINKIFXMSQFNSTSLNRHIHRTYLXGGINFADGSVQVLAATQMPEEPAGWFQGTADSIRKFIWVLXIDNIVILSGDQLYRMNYMELVQKHVEDDADITISCAPVGSSTSPFLEARLVKIDHTGRVLQFFEKPKGADLNSMRVETNFLSYAIDDAQKYPYLASMGIFLEDINAXDALLDLLKSKYIQLHDFGSEILPRAVLDHSVQACIFTGYWEDVGTIKSFFDANLALTEQPSKFDFYDPKTPFFTAPRCLPPTQLHACVSXKIGSRFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 16981 - protein, 305 aa, Bacillus anthracis str. Ames
MVIFNYILVCIIFGTTFLTIKIGIEAGAPPLFSAGIRFFLAGVILMIIFKLKRKEIMPHIFSRRIIYAGFCLTFMTFATLYWAEQYISSGLAAVLSATGPMMILLLQTKRNKTKLKKEQLLALIIALIGVVFVSLPGMHQEISFIWSIACFVLIIGELFYGIGSIRSKEILSDLQSVSLFLINGIQMFYGGVLLLIVSFIVEQPNVTVLASWSVQWPILYLIFIGSIGGHGLYYWLLSKTNPVFPSTWLYVSPLIAIIVGYIILGEPLNPIMGIGACFILVGVFLANRSTLRTYFKQGRLFEKEM

SEQ ID NO: 16982 - protein, 471 aa, Ferroplasma acidarmanus
MDNKNEGNISAINQALDNATGKFHFRTFLTAGMGFFTDAYDLFIIGTVLAILPMIGWHLTKTEIALIGSVSLIAAVLGALAFGRLLDYLGRKAIYGLELVLLVIGALGSAFLSFKNPYALMAWRFLLGVGIGGDYATSSVIMAEYSNMKTRGKYVGMVFSMQSIGLVVSSLLALTFLLSTKIIPLADAWKIMLSVGAIPAAIVIYYRRKMPEPPRYTVAKGRAAEASKNLKSYTGIDVAVSKNKEEVNAPWYTLFKDRKFLITLIGTAGAWFLMDWAFYGNSIMASRIFATIITQTGLSGLIRSTEYSAIVFIGFALPGYWLATFTLDKLGRKPIQITGFIMLAVTYGILALFPILDTPSFVVEFIAVYGISYFFMMFGPNVTTFVFPSEVFPVTTRGFGTGISAAGGKTGAFIGTFVDVFIIAAGLSSLMTVLAIFSVLGVIVTILCLPEPKGRAMEEISREKEYTKTIN

SEQ ID NO: 16983 - protein, 479 aa, Chlamydia muridarum
MAPADIGLIGLAVMGKNLVLNMIDHGFAVSVYNRSPEKTEEFLKEHGENISLQGFTAIEEFVQSLKRPRKIMIMIKAGAPVDEMISSLLPFLEEGDILIDGGNSYYLDSERRYIDLKKKGILFVGMGVSGGEEGARKGPSIMPGGNIEAWPVIAPIFQSIAAQVDGQPCCSWIGTGGAGHFVKAVHNGIEYGDIQLICETYEILKSRLDLSLEQIGNIFFEWNQTDLNSYLMGASAAVLTAKDENGVAVASTILDVAGQKGTGRWVAEDAIKAGVPMSLIIESVLARYLSAWKEVRRQAAREFPVASLLYQPSQEASVLIEDAREALYAAKIISYAQGFMLLKQISEERNWDLNLGELALIWRGGCIIQSAFLDKIHQGFESCPDAHSLMLQDYFKNVLLNSETGFRRAILHAVGAGVAIPCLASALAFYDGYRTENSPLFLVQGLRDYFGAHGYERQDRPRGEFYHTDWLGSKNASRM

SEQ ID NO: 16984 - protein, 372 aa, Desulfitobacterium hafniense
MTNAIGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSERIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAVI

SEQ ID NO: 16985 - protein, 502 aa, Oryza sativa; identical to SEQ ID NO: 10274

SEQ ID NO: 16986 - protein, 150 aa, Gibberella zeae
WRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAK

SEQ ID NO: 16987 - protein, 229 aa, Oryza sativa (japonica cultivar-group)
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLG

SEQ ID NO: 16988 - protein, 290 aa, Chlorobium tepidum TLS
MLVKEIFDARTEPVFSLEFFPPKKQDDWDKLFETISNLFPLDPSYVSVTYGAGGSTRERTHNLVTRIQQETGLTVVSHLTCIGAEKSEIESVLQNYREHGITNVLALRGDKPADITTLEEATKDFPHAIDLVKFIKENFPEMGIGVAGFPEGHPETPNRMKELEFLKEKVDAGADYIVTQLFFDNHDYFDYVERCELAGITVPIIPGIMPIMSKKGMIRMCELALGSRIPSKLLRKVLEAADDKEVAEIGVEWATNQVQELLDHKVKGVHFYTLNLSEATLKIFRNLKRG

SEQ ID NO: 16989 - protein, 195 aa, Oryza sativa
MQSQIVCHGCRSVLRYPSGAPSVCCALCQAITTVPPPAPVMEMAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPSGSSYNAPPPTSAPTSRPQNVTVVVENPMTVDEKGKLVSNVVVGVTTGK

SEQ ID NO: 16990 - protein, 90 aa, Zea mays
  unsure (1)..(90): unsure at all Xaa locations
PLTFAEITTQDTPXPSKTVLAFGLPGNPVSCIDCLNLLDVPAIRLLTGWSNRHLQRVHVRISHAXRAYPHRTEVHRAVLRSVLDDGSGRP

SEQ ID NO: 16991 - protein, 501 aa, Glycine max
MTSLTNGDAGSLNKVPTIKFTKLFINGDFVDSLSGKTFETIDPRTGDVIARISEGDKEDIDIAVKAARHAFDNGPWPRLPGSERARILLKWAEIIEENAEELAALDAIDAGKLYHMCRNVEVPAAANTLRYYAGAADKIHGEVLKMSREFHAYTLLEPLGVVGHITPWNFPNTMFYIKVAPSLAAGCTMVLKPAEQTPLSALFYAHLAKLAGIPDGVINVVPGFGPTAGAALSSHMDVDKVSFTGSTQTGREIMQAAAKSNLKPVSLELGGKSPLIIFDDADIDKAAELALFGIISNKGEICVASSRVFVQEGIYDEFEKKLVEKAKSWVVGDPFDPKVQQGPQVDKNQFEKILSYIEHGKREGATLLTGGKTVGNKGYYIEPTIFSNVKEDMLIAQDEIFGPVIALMKFKTIEEAIKSANNTKYGLAAGIVTKNLDTANTVSRSIRAGIVWINCYFAFGDDVPFGGYKMSGFGRDHGLEALHKYLQVKSVVTPLYNSPWL

SEQ ID NO: 16992 - protein, 351 aa, Oryza sativa (japonica cultivar-group); identical to SEQ ID NO: 14291

SEQ ID NO: 16993 - protein, 119 aa, Phaseolus vulgaris
NIDNFFTEDEQLAFCPAIVVPGVYYSDDKMLQTRIFSYADSQRHRLGPNYLQLPANAPKCAHHNNHHEGFMNFMHRDEEVNYFPSRYDSVRHAESFPIPPAICSGRREKCGIEKENNIK

SEQ ID NO: 16994 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVCDTAVVVWALNTLRLPDERRRRDAMTKGFRWIVGMQSSNGGWGAYDVDNTSDLPNHIPFSDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 16995 - protein, 254 aa, Chlamydophila caviae GPIC
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 16996 - protein, 410 aa, Brucella suis 1330
MSDDVVLSLHVPEPEWRPGDAPDFSHVKIPRAGSVRRPEIDEKPEAMRDMAFSIIRMLNREGEAVGPWAGTLTDEELKDGLRHMMMLRAYDARMMMAQRQGKTSFYMQHLGEEAVSCAFRKALRKGDMNFPTYRQAGLLIADDYPLVTMMNQIFSNEQDPLKGRQLPVMYSSKEHGFFTISGNLATQYTQAVGWAMASAISHDTKIAAAWIGDGSTAESDFHATLVFASTYKAPVVMNIVNNQWAISTFQGIARGGSGTFAARGHGFGIPSLRVDGNDYLAVHAVAKWAVERARRNLGPTIVEYVTYRAGGHSTSDDPSAYRPKAENDAWPLGDPILRLKNHLIKRGVWSEERHKQAEAEVMDIVVSAQREAEAIGTLHDGRKPSMRDMFEDVYAETPPHLIRQRQEAGF

SEQ ID NO: 16997 - protein, 373 aa, Zea mays
  unsure (1)..(373): unsure at all Xaa locations
MRRWLCCNCHYDVEEDDHAKEQAKAQSNKTDSKQKSSKPPGSQPEPEFSPPTIDVPELSLDDLKLKTDDFGSSALIGEGSYGRVYHATLDDGRQAAVKKLDASENEPNDEFLKQVSLASKLKHENLVEMLGYCVDGNYRILAYEFATMGSLHDVLHGRKGVQGAQPGPVLDWMQRVKIAIEAAKGIEYLHGNXQPSIIHRDIRSSNVLLXFEDFTAKIADVNLLRPSTCYGSLVSVSTRVXEGVFGYHAPXEYAMTGQLTQKSDVYSFGVVLLELLTGRKPVXDHTMPRGQQSLVTWATPRLSEDKVKQCVDPRLKGEYPPKGVAKLAAVAALCAQYEAEFRPNMSIVVKALSPLLQQRPAPTTEEPAPQPGS

SEQ ID NO: 16998 - protein, 251 aa, Zea mays; identical to SEQ ID NO: 4945

SEQ ID NO: 16999 - protein, 324 aa, Zea mays
IGYLEAGRDHIPTSRTRTNCYPLASPSPPPLQFSPTNRSSSETENGRGAVVPRVLPSLPPRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGITFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 17000 - protein, 427 aa, Vibrio parahaemolyticus RIMD 2210633
MVMTLTLMHRMSALQITEINIMSVTADQVHGVVQALTQSSDTLFLLLGAIMVFLMHAGFAFLEVGTVRQKNQVNALVKIIADFGISAIAYFFIGYWVAYGGTFFSDAQTLSQDNGYELVKFFFLLTFAAAIPAIVSGGIAERARFYPILIATFFTVGVVYPLFEGMIWNGNFGVQAWFESTFGYGFHDFAGSVVVHGVGGWIALVAVTFLGMRRGRIRAGKHTNFAPSNIPFLALGAWILCVGWFGFNVMSAQTLSGISGLVAMNSLMAMVGGIVASLLAGKNDPGFIHNGPLAGLVAVCAGSDLMHPLGALVTGAVAGVLFVYLFTYLQNRTKIDDVLGVWPLHGVCGAWGGIAAGVFGQSGFGGMGGVSFAVQVLGTFFGISIAVLGALVVYGAINALTGLRLSEEDEFNGADLAIHKISSTNED

SEQ ID NO: 17001 - protein, 522 aa, Ipomoea tricolor
MATLTLILCTLVFAICLYFLILRVKQRYPLPLPPGPKPWPVLGNLPHLGEKPHQSIAAMAQSYGPLMHLRLGFVDVVVAASAAVAAQFLKVHDANFSSRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGSSKSDPKAEEFKSMVEEMMVLAGSFNIGDFIPVLGWLDLQGIVGKMKKLHARFDAFLNTILEEHKFVNNQDTTLFKDMDFLSTLIRLRDNGAAMDGEDGKVTGVTDTEIKALLLNLFTAGTDTSSSTVEWAFAELLRNPKILNQAQQELDLVVGPNRLVTESDLTQLPFLQAIVKETFRLHPSTPLSLPRMGAESCEINGYFIPKGATLLVNVWAIARDPNVWTNPLEFNPHRFLPGGEKPNVDIKGNDFEVIPFGAGRRICSGMSLGIRMVHLLVATLVHAFDWGLVDGQSVDTLNMEEAYGLTLQRAVPLMLHPKPRLQPHIYTLN

SEQ ID NO: 17002 - protein, 215 aa, Hordeum vulgare subsp. vulgare
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEVEQFAKEHGLVFMEASAKTAQNVEEAFIKTAGTIYKKIQDGVFDVSNESYGIKVGYAVPNASGGGAGLVLSNQGRLLAIKQV

SEQ ID NO: 17003 - protein, 743 aa, Schizosaccharomyces pombe
MPVAEIKNATQQPSSTNRVQAYAKLEFEKFSFFVQTLQVTMGRKASNSSDCDVHLGDTKAISRQHAKIFYSFPNQRFEISVMGKNGAFVDGEFVERGKSVPLRSGTRVQIGQISFSFLLPEGSEEDGHLKETGITPLSLQQGKIAYSDEFGGKPTGSFHTVTSNQEKDLLFSHIKHESDLPLGLSPADTNISNATSIIEHPDAANAHTLASLNQPPKHLTVSPSSIQRLSPQPYVRPTSDERPIETDSSVSAPKVANHDEELKQGKSTSPSDTVLHPDLNGSPDTGDATQKPNLSYANLIARTLIANPNKKMTLGDICEWIANNWSYYRHQPPAWHNSIRHNLSLNKAFIRIPRRQNEPGKGSFWMLDPSYIDQFEGNFFRRTKKPTPSATPAAHPDTARENELAAIQTKGISAGKTEQLNPQKETSRSKTHTSRGENVEDRPQSLLQNGIQPIIMRDGKLALNPEFFKNANGEQQAPNEQAVQAISLLQQHINKQLGPAAANNPEQATAIANALAVALAQKLQKQQTQMQGPQQVQQQAKRRKAYTSQQLNPAPTAMPHPNITSPSPSISVTQRPAVNVGPPPYVRPSAPSKLPDTRQSIGDPLPPGAMANVSAGPSSVRSSSYNSTASESKSEITSHQNLHTIPINKPFTSDRPLYSSPNDTLERVETGNQGQRMNSIGNASSFSKRDIMENENGSFDTNAKNGNNVDDSSSVRGMNLPSNSSDALRGVKRPLDETSSSYT

SEQ ID NO: 17004 - protein, 337 aa, Brassica napus
MAGIRLAPEEPETTPQQHARATTDSLASDDDRSIAADSWSIKSEYGSTLDDDQRHADAAEALSSANFRVSSDYSSDKEEPDADGGQSMLGLQSYWDAAYSDELSNFREHGHTGEVWFGDDVMEIVTSWTKDLCVEISQKEMSVSDNGEVNDQADKYLSSWNVLDLGTGNCLLLHQLAKEGFSDLTGTDYSEGAVELAQHLSQRDGFPNIRFMVDDILDTKLERQFKLVMDKGTLDAIGLHPDGPVKRVMYWDSVSKLVAPGGILVITSCNNTKDELLEEVENFNMRKSNLTGDVSSEAASGTDYPPFEYLSHVRTYPTFMFGGSVGSRVATVAFLRK

SEQ ID NO: 17005 - protein, 398 aa, Malus x domestica
MEDYNNQMDHESSGGRGNFLYASPNLGGNYGRAASDHQMGINTFHLQSSGGGGGGGSGDQCNFQSPGTHPINVKTEATTSQHGHPKFQYNNNNNNHHLVSSSRGHQPVVHQLQHNLDLQNDDHSLSSNEVEAIKAKIIAHPQYSNLVEAYMDCQRVGAPSDVVPRLSVARQEFEARQRSSGTSRETSKDPELDQFMEAYYDMLVKYREELTRPIQEAMDFMRRIETQLNMLGNNNNAPPLRIFSPSEDKCEGIGSSEDEQENSGGETEVPEIDPRAEDRELKNHLLRKYSGYLSSLKQELSKKKKKGKLPKEARQKLLSWWELHYKWPYPSESEKVALAESTGLDQKQINNWFINQRKRHWKPSEDMQFMVMDGLHPQNAALYMDGHYTGDVHYRLGP

SEQ ID NO: 17006 - protein, 468 aa, Methylococcus capsulatus
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGANGNGMHVHQSVAKDGKNLFSGDLYGGLSETALHYIGGYISMPKALNAFCNASTNSYKRLVPGFEAPVMLAYSARNRSASIGIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTACDEHSSVEFDMYYSL

SEQ ID NO: 17007 - protein, 490 aa, Escherichia coli
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQI

SEQ ID NO: 17008 - protein, 544 aa, Vibrio parahaemolyticus RIMD 2210633
MTPAELKRLYHIIKVQLEYGLDELLPDHQLTKAPLLMRKSLFWIKNQHPEKPLGERLRLALQELGPVWIKFGQMMSTRRDLFPPHIADPLALLQDQVAPFDGELAKQQMEKALGGPLENWFTEFDIKPLASASIAQVHTARLKDTNQEVVLKVIRPDIRPVIDSDLKLMHRMARIVAGAMPEARRLKPVEVVREYEKTLLDELDLRREAANAIQLRRNFEGSEELYVPEVFPDFSNETVMVSERIYGIQVSDIEGLEANGTNMKLLAERGVSVFFTQVFRDSFFHADMHPGNVFVKPEHPENPMWIGLDCGIVGTLNSEDKRYLAENFLAFFNRDYRRVAELHVDSGWVPADTNVDEFEFAIRIVCEPIFAKPLCEISFGHVLLNLFNTARRFNMEVQPQLVLLQKTLLYVEGLGRQLYPQLDLWETAKPFLEEWMMNQVGPQALVNSIKDRAPFWAEKLPELPELLYDSLKQGKAMNQRMDLLYQGYRQSKRQQATGKFLFGVGATLVVCSAILVDNAYEQLSMASGIAGVTFWLLSWRAYRQ

SEQ ID NO: 17009 - protein, 335 aa, Saccharomyces castellii
MSEPAQKKQKTTGSSLEQLKASGTVVVADTGDFASIAKFTPQDSTTNPSLILAAAKQPAYAKLIDVAVSYGKKNGKTTDEKVELAVDRLLVEFGKEILKIVPGRVSTEVDARLSFDKEATIAKALEIIKLYEDLGISRERVLIKIASTWEGIQAARELESKHKIHCNLTLLFSFSQAVACAEAKVTLISPFVGRIMDWYKAKTGETYNGRNDPGVLSVHKIYNYYKKHGYKTIVMGASFRNVDEIKNLAGVDYLTISPNLLDELLNSNDHVPRVLDVATAKKEGAEKISYIDDEATFRFSLNEDAMGTEKLAEGIRKFSADIVTLFDMIEKKVTA

SEQ ID NO: 17010 - protein, 444 aa, Arabidopsis thaliana
MATITVVKARQIFDSRGNPTVEVDIHTSNGIKVTAAVPSGASTGIYEALELRDGGSDYLGKGVSKAVGNVNNVIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETKDTFIADLAVGLSTGQIKTGAPCRSERLAKYNQLLRIEEELGSEAIYAGVNFRKPVEPY

SEQ ID NO: 17011 - protein, 498 aa, Shigella flexneri 2a str. 301
MHTDSNDGHYILRFDNERKTNQRRRIMETNIVEVENFVQQSEERRGSAFTQEVKRYLERYPNTQYVDVLLTDLNGCFRGKCKPVSSLYKLDTRRYLVASIFALNILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 17012 - protein, 495 aa, Oryza sativa
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVAACRTLGRPHRGPPHWRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSFGGFMLKSAHGTQVAAEMGGHV

SEQ ID NO: 17013 - protein, 192 aa, Zea mays
  unsure (1)..(192): unsure at all Xaa locations
ALQKPEFALGPPDFGIVLLPNSKVLFSPKVYFPLPSFSGFPDGTKTFVGAQNGELRIFSPRGDTLSKKALLXKPRGAFPSLPFSPKGFMFGFAEAPKETFLWGRARKKIQLKNLLFPPARINSLGWSPAHRLVAPGSLGPWAIVFEINKPVARWVPIKGGPLGGGPGLTLLEKKTLVAPREEACLCVLKGVE

SEQ ID NO: 17014 - protein, 537 aa, Oryza sativa
  unsure (1)..(537): unsure at all Xaa locations
MATCAADLAPLLGPVAANATDYLCNRFADTTSAVDATYLLFSAYLVFAMQLGFAMLCAGSVRAKNTMNIMLTNVLDAAAGALFYYLFGFASLXVAFGTPSNGFIGKQFFGLKHMPQTGFXDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISXAEDETSGMDLTRHGGFAYVYHDEDEHDKSGVGGFMLRSAQTRVEPAAAGCLQQQQPSVTNPERTTSQRRKKSRVSLPLRSRSSRHKFDPHI

SEQ ID NO: 17015 - protein, 379 aa, Zea mays; identical to SEQ ID NO: 12077

SEQ ID NO: 17016 - protein, 433 aa, Zea mays
  unsure (1)..(433): unsure at all Xaa locations
LRHLVFDPLVRGPWRRPWLSATTVPLQQGGGLSEFSGLRSSASLAHARRNXATSDDFMSAVSFRXTHAVGTSGGSRRAXPTEAKLKVAINGFGXRIGRNFLRCWHGRGXASPLDVIAINDTGGVKQASHLLKYDSTLGIFXDADVKPVGDNAXISVDGKVIKXSVSDRNPSNLXPWGRARPSTLVIEGTRALFVDRXGPRGKHIQAGGQEGAHHRRPGKGDIPHLTSVGRQCPTSTTPDEPIISNASXTTNCLAPFVKVLDQKFGIIKGTMTTXTHSYTGDQRLLDASHRDLRRARAAALNIVPTSTGAAKAVSLVLPNLKGKLNGIALXGCPPPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 17017 - protein, 281 aa, Clostridium tetani E88
MSIVKMKQLLKNAQKGQYGIGAFSISNMETIIGAVRAAEELKSPIILQIAESRLKHSPLYLIGPVMIEAAKKSSVPIAVHLDHGESIDTIKEALDLGFTSVMYDGSHFNLSKNIENTKEVVSLTKEYGASVEGEVGKVGKKEDGLGDDTISITTVEDAEKFYKETNVDALAIAIGNVHGMYVGKPNLDIKRLIEVNSNIEVPLVLHGGSGITKEEFKNCIKNGITKINVATATFNSVIDKVNELFKTSNSVDYFTYHDVVINAAYDNVKKHIDIFGSSNKA

SEQ ID NO: 17018 - protein, 227 aa, Neurospora crassa
MNVLEWAFGKRMTPAERLRKNQRLLDKAIRELDQQRVKLEKQEKTLVSQIRQSAQKGQMGACKIQAKDLVRTRRYIEKFYSMRSQLQKISLRLQTYRTNEQMMQAMKGATMALGSMNRTMNLPSLQRIAMEFERENDIMEQRQEMMDDAIDDAMDMGLEEEGDEVVEQVLEEIGVDLSQAMGETPSGLQVAAVPENKVAQAVGGGGGGGGADPGDDDLQARLDSLRR

SEQ ID NO: 17019 - protein, 273 aa, Oryza sativa (japonica cultivar-group)
MACALVALVLGLCCVGGARATGRIDEGLEVMWGDGRGSVSPDGQVMALSLDHTSGSGWRSKNTYLFARVDLQIKLVANNSAGTVTTCYFMSEGEWDIHDEVDLEFLGNVTGQPYTLHTNVFANGTGGKEQQFHLWFDPTTDFHTYSIVWTSQHILVLVDGTPIREMKNHADKGIAYPSSQRMRLYGSLWNADDWATQGGRVKTDWSQAPFVARYRNFTATEAASSSSPAGYDQQMDATAQQAMKWARDNYMVYDYCADSKRFPQGFPPECSMP

SEQ ID NO: 17020 - protein, 491 aa, Solanum tuberosum
DPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 17021 - protein, 64 aa, Oryza sativa
MSGAGEEDKKPAEGGGAHINLKVKGQDGNEVFFRIKRSAQLKKLMNAYCDRQSADMNAIAFLFD

SEQ ID NO: 17022 - protein, 419 aa, Grateloupia sparsa
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTW

SEQ ID NO: 17023 - protein, 480 aa, Opephyllum sp.
  unsure (1)..(480): unsure at all Xaa locations
QAIKNERYESGVIPYAKMGYWDPNYVTKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAAXXXXXXXXXXXXXXXXXVIVMIDLVIGYTAIQTMAIWARKNDMILHLHRAGNSTYSRQKVHGMNFRVICKWMRMAGVDHIHAGTVVGKLEGDPLMIKGFYNTLLEPYLDINLPQGIFFQQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 17024 - protein, 291 aa, Boletus edulis
LENPEINITAVNDPFIDLDYMVYMFKYDSVHGRFEGEVSTKDGKLVINGKAITVFAERDPANIPWGTVGAQYVVESTGVFTTIEKASAHLKGGAKKVIISAPSSDAPMFVCGVNLDAYDPKHTVISNASCTTNCLAPLAKVVNDKFGIVEGLMTTVHATTATQKTVDGPSPKDWRGGRAVNNNIIPSSTGAAKAVGKVIPVLNGKLTGLAFRVPTLDVSVVDLVVRLAKPTSYEEIKTAFKEASESSELKGIVAYTEDAVVSTDFLGHHASSIFDATGGIMLNDSFVKLIA

SEQ ID NO: 17025 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 17026 - protein, 519 aa, Brassica rapa subsp. pekinensis
MATMAAIGSLKVPSSSSNHTRRLSSSSQRKTLSFSSSSLTGEKLNPTQEIIISNLPRWQREKNAIDSPKAVSDSQNSQTCLDPDASRSVLGIILGGGAGTRLYPLTKKRANRAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSKMLDADVTDSVIGEGCVIKNCKIHHSVIGLRSCISEGAIIEDTLLMGADYYETDADRTLLAAKGRVPIGIGENSHIKRAIIDKNARIGDNVKIINTDNVQEAARETDGYFIKSGIVTVIKDALIPSGTVI

SEQ ID NO: 17027 - protein, 130 aa, Zea mays
MADPELEAIRKRRMEELMAKHGGGGANQQNASQQKAQEDAKQEAEGRRRMMLAQILSSEARERISRIALVKPDKARGVEDVLLRAAQTGGISEKVSEERLISLLEQINTHTSKQTKVTIQRRRSVLDDDD

SEQ ID NO: 17028 - protein, 149 aa, Zea mays
MISAKRVAHLAKKWQRMAAQRRQRLTWGGAGAAAKQAGESCSSVASKGHCAVYTADWARFEVPLACLSTLVFRELLEMSQEEFGFSGGDGSGRITLPCDTAVMEYAMCLLRRSASAELEQAFLSTVAATSCLYASRVAPCVGACQRVAV

SEQ ID NO: 17029 - protein, 348 aa, Marchantia polymorpha
MAGSTEPSTISSGKVKIGINGFGRIGRLVARVALERDDIELVAVNDPFISTEYMAYMFKYDSVHGRYTKNTIEAKDDKTLLFGKFPVSIFQCRDPAEIPWGQTGAEYVVESTGVFTTKDKAAAHLKGGAKKVVISAPSADAPMFVMGVNEKEYTTDIDIVSNASCTTNCLAPLAKVIHDKFGIVEGLMTTVHSITATQKTVDGPSAKDWRGGRGASFNIIPSSTGAAKAVGKVLPALNGKLTGMSFRVPTADVSVVDLTVRTEKKATYEEVKAAIKAESEGEMKGIMGYTEDDVVSTDFIGDSRSSIFDAKAGIALNDNFMKLVSWYDNEWGYSNRVVDLILHMASTQ

SEQ ID NO: 17030 - protein, 405 aa, Zea mays
  unsure (1)..(405): unsure at all Xaa locations
LARRGGGGPYIFNTCAWRGPEEAQAEAAPALEGAWVWATAGRRRSRATHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHXKQQFRVRFPTMSXGAMDLLERMLVFDPSKRITVDEALCHPYLASLHEVNDEPICPAPFSFDFEQPSLTEEAIKELIWKESLKFNPDPIH

SEQ ID NO: 17031 - protein, 234 aa, Helicobacter pylori 26695
MTKIAMANFKSAMPIFKSHAYLKELEKTLKPQHFDRVFVFPDFFGLLPNSFLHFTLGVQNAYPRDCGAFTGEITSKHLEELKIHTLLIGHSERRTLLKESPSFLKEKFDFFKSKNFKIVYCIGEELTTREKGFKAVKEFLSEQLENIDLNYPNLVVAYEPIWAIGTKKSASLEDIYLTHGFLKQILNQKTPLLYGGSVNTQNAKEILGIDSVDGLLIGSASWELENFKTIISFL

SEQ ID NO: 17032 - protein, 72 aa, Triticum aestivum
GGSAISYGVYFYNATRGSLTTLSSLTFLTPMFASIFGFLYLGETFSPVQLGGALLTLVAIYMVNYKSIVGEK

SEQ ID NO: 17033 - protein, 411 aa, Zea mays
MRHHLMCPISLQPMQDPVTAPTGITYDRRAIERWLAAGHATCPVTGQPLALADLTPNHTLRRLIQSWCAPRPSTPPEAAGANKPADGDDDAVEHSQSQTDDDVVKKLLRAATSPPIDVLREAAAAAFESDAARRRMVDAGVLQRVLRGVAAIASEVKADDPRHHENESRSSSAIARAIEARLDLARALAVSSCDDDELRPQLVSDSLVHGLLDAATDVLAALERAGGGGGDDGDAARASAVRLLDSVTGAAGAAVLERLRPGLFRAVTAVVRDRVSPAATRSALRVLLHACPLGRNRALAVEAGAAREAIELELDAPPPPPGGGGGRRATELALALLAELCACADGRAAVAAHPAGVAVVARRLLRVSAAADACAVRVLAAVGGRAASPEVLREMARVGAVGKLCCVLQAC

SEQ ID NO: 17034 - protein, 490 aa, Escherichia coli
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 17035 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGILISYEGKVQLLEIAQVPEEHVDEFKSIEKFKIFNTNNLWVNLNAIKRLVDADALKMEIIPNPKEVNGVKVLQLETAAGAAIKFFDHAIGINVPRARFLPVKATSDLLLVKSDLYNVRDGFVIRNKLRRDPQNPVIQLGPEFKKVDDFLSRFKSIPSLLECDGLRVDGDIWFGSGIKLKGNVHCSVSSEEMLNIPDNITLRE

SEQ ID NO: 17036 - protein, 142 aa, Triticum aestivum
  unsure (1)..(142): unsure at all Xaa locations
MGNPXXLMXQIFDLKFXSKSLXRXARKCDXDEKEQKLKVXKAIXKGNXDXXRIYAXNAIXKRTXHMXXXRLASRLDAVVTRLDTXAKMXAIGXSMGSIXXXNSSLAXGXLHQHSETXXXPAQFVNMEVXXIMXGXWPNPLQP

SEQ ID NO: 17037 - protein, 221 aa, Gibberella moniliformis
SSGVFTTIDKAKAHLTGGAKKVIISAPSADAPMYVVGVNENKYDGSADIISNASCTTNCLAPLAKVINDKFGIVEGLMTTVHSYTATQKTVDGPSAKDWRGGRGAAQNIIPSSTGAAKAVGKVIPELNGKLTGMSMRVPTANVSVVDLTVRLEKGASYDQIKKVIKEASEGDLKGVLAYTEDDVVSSDLNGNTNSSIFDAKAGISLNDNFVKLVSWYDNEW

SEQ ID NO: 17038 - protein, 466 aa, Porphyra papenfussii
YAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASAAAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTEINLPQGLFFAQNWASLRKVVPVASGGIHAGQMHQLLDYLGDDVVLQFGGGTIGHPDGIQAGATANRVALESMVVARNEGRDFVAEGPQILRDAAKTCGPLQTALDLWKDISFNYTSTDTADFVETPTANV

SEQ ID NO: 17039 - protein, 376 aa, Trichodesmium erythraeum IMS101
MFTFIRSNLNNLKAYTPHSAGSSEILLDRLDTNECPYDLPDNLKQKLAENYQQLIETNRYPDGSHLKLKEAIAKYVNEVTPSANISANNISVGNGSDELIRSLLIVTCVGGEGSILTATPTFSMYSILAQTLGIPVVNVGRKESNFEIDITAAEDAINHTKNPSIKAIFVVHPNSPTANALNSQELVWLRSLPDDILVVIDEAYFEFSQTSLAEELNQHPNWVILRTFSKAFRLASLRVGYAIAHPEIIINLEKVRLPYNLPSFSQAAAQLVLNHSQHLLSFIPEILRERSKLFATFGEIPALKVWKSAANFLYMRLTDEGLKLMGKSSQDQSLSSLMQRLKTQGTLIRHTGGGLRITIGTSEENQRTVERIKGIF

SEQ ID NO: 17040 - protein, 289 aa, Zea mays
  unsure (1)..(289): unsure at all Xaa locations
MDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQDEVVTRIEERISAWTFLPPENGEAIQILHYQNGEKYEPHYDYFHDKNNQALGGHRIATVXLMYLSNVXRGGETIFPNAEGKLLQPKDDTLGXCPCLFFSLHPDSTTDSDSLHGSCPVIEXGQKWSATKWXIMVRSFDLTPSSSRVPLMDVRTTMSLCPQWAAVGECAKNPNYMVGTKEAPGFCRKSCKVCAE

SEQ ID NO: 17041 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 17042 - protein, 488 aa, Coelocladia arctica
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEIKGSYLNITAATMEQMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 17043 - protein, 525 aa, Staphylococcus carnosus
MKIKAQVAMVLNLDKCIGCHTCSVTCKNTWTNRPGAEYIWFNNVETKPGVGYPKRWEDQEHYKGGWTLNKKGKLDLKAGSRWSKIAFGKIFYNPDMPVIKDYYEPWTYNYEHLTTAKASKHSPVATAHSVISGDKIDLHWGPNWEDDLAGGHVTGPEDPNIQRIEEKIQFDFDQTFMMYLPRLCEHCLNPSCVASCPSGAMYKRDEDGIVLVDQDACRGWRYCMTGCPYKKVYFNWKTNKAEKCTFCFPRVEAGMPTVCSETCTGRMRYLGVLLYDADRVHEVASCENEQDLYEKQCELFLNPYDEDVIEQAKKDGITMDWIEAAQNSPVYKLAIEYKLAFPLHPEYRTLPMVWYCPPLSPIMNYFEGKDSIKNPDAIFPAIEEMRLPIEYLASLLTAGDTKSVKEALQRMAMMRSYMRAQVTGKEFDTDRLARLGLTERQTKDMYRLLAIAKYEDRFVIPTSHKEEYMDTYAAQGSQGYTFGDQMNGTGSGSGCEGCGAPVAMKPGQTGQEAYNESFYGGIFRD

SEQ ID NO: 17044 - protein, 254 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQHDVDGFLVGGASLKPEFVDIINAAEAAKQA

SEQ ID NO: 17045 - protein, 80 aa, Zea mays
  unsure (1)..(80): unsure at all Xaa locations
MAEPGLEGSQPXDLSKHPSGIVPTLXRFAAVIMRIREPKTTALIFASGKMVCTXAKSEQXSKLAARKXARIIXXLGFPVK

SEQ ID NO: 17046 - protein, 488 aa, Gelidium serrulatum
  unsure (1)..(488): unsure at all Xaa locations
MSNSVEERTRIKNERYESGVIPYAKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYTNVTAATMEDMYERAEFAKQLGTVIIMIDLVIGYTAIQTMAIWARKDDMILHLHRAGNSTYSRQKXHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 17047 - protein, 84 aa, Arabidopsis thaliana
MKVKILRWHAVASWTWDAQDETCGICRMAFDGCCPDCKLPGDDCPLIWGACNHAFHLHCILKWVNSQTSQAHCPMCRREWQFKE

SEQ ID NO: 17048 - protein, 301 aa, Neisseria meningitidis
MPSENPSQRKKEKMKGIILAGGSGTRLYPITRGVSKQLLPVYDKPMIYYPLSVLMLAGIRDILVITAPEDNASFKRLLGDGSDFGISISYAVQPSPDGLAQAFIIGEEFIGNDNVCLVLGDNIFYGQSFTQTLKQAARQTHGATVFAYQVKNPERFGVVEFNENFRAVSIEEKPQRPKSDWAVTGLYFYDNRAVEFAKQLKPSARGELEISDLNRMYLEDGSLSVQILGRGFAWLDTGTHESLHEAASFVQTVQNIQNLHIACLEEIAWRNGWLSDEKLEELARPMAKNQYGQYLLRLLKK

SEQ ID NO: 17049 - protein, 566 aa, Phaseolus vulgaris
IFQFRTGFIAPSSRVFGRGVLVEDSWAIARRYLSSYFLVDILAVLPLPQVVILVIIPKMSGFKSLNTKNLLKFVVFFQYVPRLLRVIPLYREVTRASGILTETAWAGAAFNLFLYMLASHVVGAFWYLFSIERETTCWQEACRSNTTVCNKADMYCNDYWGGLSKISTFLNTSCPIQKEDKNLFDFGMFLDALQSGVVESRDFPQKFFYCFWWGLKNLSSLGQNLGTSPMFGKYALQFSFLYLVWVFSFLIGNMQTYLQSTTTRLEEMRVKRRDAEQWMSHPIASDGLRVRIRRYEQYKWQETRGVDEDNLVRNLPKDLRRDIKRHLCLALLMRVPMFEKMDEQLLDAMCDRLKPVLFTEESYIVREGDPVDEMLFIMRGKLLTITTNGGRTGFFNSEYLKAGDFCGEELLTWALDPHSSSNLPTSTRTVQTLSEVEAFALKADDLKFVASQFRRLHSKQLRHTFRFYSQQWRSWAACFIQAAWRRYSKRKLEESLVEDENRLQNVLAKSGGSSPSLGATIYASRFAANALTLLRRNGAKKGRVAERLPPMLFQKPAEPDFTADEE

SEQ ID NO: 17050 - protein, 644 aa, Cryptococcus bacillisporus
MAFSPSLTPSRPAPVPPRRAAGTAHHMIGVTDTAAAPQSNFSSTSYSPSFSYTNSSIQSTKIADTRRSRTIRSGAASIKEEGLRAFMWSKRWLVLGSAELRIYKNESSSSPVYTVSLEDIQDVQRVDLKPYCVEIETSDKLLYFAFRSDNEVYGWMDDINSRTPRLGVSQPTNFVHQVHVGCDPKSGGFTGLPPQWSKLLTSSAITEEEAARNPEAVLDVLQFYTQQQASDVLEGYQKFPLPSVSNQYLTTGAAATRFEGVGLGGQQQQQQQRLRSAPFAATGSLVTTVVSGPRSFDTETKTLAQKEKEIVLNPQRQPLDSVTRPSVGKNDKEKVMRSPGPTVEKRISTMNEVQIMEKLRSVVSAKDPSQLYSKIRKVGQGASGMVFVAKTLSNGKKVAIKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMAIEMIENEPPYLDEEPLKALYLITTNGTPTLKSPEKLSQDLKHFLSVCLCVDVAFRATSTELLKHEFLQLACSVQDLAPLLRFKQDTL

SEQ ID NO: 17051 - protein, 202 aa, Prochlorococcus marinus str. MIT 9313
MLLIIDNYDSFTFNLVQYLGELAAKHPVAADLRVERNDALCLSQIRELHPAAILLSPGPGNPDQSGVCLEVLTELAPTIPTLGVCLGHQALAQAYGGKVVQADELMHGKTSPVLHNGEGLFKGLPLPLTATRYHSLIAERESLPDCLEVTAWLEDGTIMGLRHRTHPHLQGVQFHPESVLTEAGHQLLTNFLRLTEASEKHC

SEQ ID NO: 17052 - protein, 315 aa, Prochlorococcus marinus subsp. marinus str. CCMP1375
MTWSINSIPSQEGRTVFVTGANSGLGFDTAQALLEKGATVILGCRTLEKAERSRQKLLDETDCGKIDVLEIDLADLEKVNEALDKIAVKYKKLDLLINNAGVMAPPQTFSKQGFELQFAVNHLSHMALTLKLLPLIAKQPGSRVVTVSSGAQYMGKINLDDLQGGEGYDRWSSYSQSKLANVMFALELSKRLQQSNLDIASLSAHPGLARTNLQSTSVKLNGSWQEAIAYKLMDPMFQSSRMGALPQLLAATDPTAKTGEQYGPRFNFRGYPKICRIAPSALNSDEREQLWQLSEKLIGDAVDISKGKELLSTKK

SEQ ID NO: 17053 - protein, 294 aa, Vigna unguiculata
  unsure (1)..(294): unsure at all Xaa locations
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSXMLSLDPSKRITARIAVEHEYFKDIKFVP

SEQ ID NO: 17054 - protein, 330 aa, Oryza sativa
  unsure (1)..(330): unsure at all Xaa locations
WRRRRPSRPPTSPASPTSAAQASPPPPRRIRSSSASGAPAAAXQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKERYGDRVGVKRVDARAMGGIAKSHRPRSTAAVVFLLGIGVWDEP

SEQ ID NO: 17055 - protein, 447 aa, Gigartina pistillata
  unsure (1)..(447): unsure at all Xaa locations
ALFRVSPQPGVDPVEASAAVAGESSTATWTVVWTDLLTACDLYRAKAYKVDIVPNTTDQFFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDXXXXXXXXXMRWKERYLYSMEAVNRSIAASGETKGHYLNVTAATMEEMYERAEFAKQLGSIIIMIDLVIGYTAIQTMAVWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHHLLDYLGIDVVLQFGGGTIGHPDGIQAGATANRVALESMAIARNEGRDYVAEGPQILQDAAKTCGPLQTALDLWKDITFNYTSTDTADFVETPTANV

SEQ ID NO: 17056 - protein, 143 aa, Glycine max
  unsure (1)..(143): unsure at all Xaa locations
ALNLALGSLPQFTICNRAGAGGXVXFTVPLFTAGLPTRKTNNDITNIVSNGGRVRCMQVWAPVGKKKHETLSYLPDLDDAQLAKEVEYLPRKGWIPCLESEREHGLVYREHIRLPGYYDGRYWTMWKLLMIGCTDASQVLKEL

SEQ ID NO: 17057 - protein, 237 aa, Saururus chinensis
MGRGRVQLKRIENKINRQVTFSKRRTGLLKKAHEISVLCDAEVALIVFSTKGKLYDYSTNAGMARILERYERYCYAEREVAVTSPDSEGSWWLEYGKLKARIEAQQRIQRQLMGEDLDALTPKELQQLENQLESALKHVKSRKNQVIYDSMVELRRKEKLLRDENTMMEKKIQEKKKERVQQAQWEQQIQSQNSPSFLPTLNIGYHQGTATETGEKEEAHPGHNTVMLAWLLRSSNN

SEQ ID NO: 17058 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSSFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 17059 - protein, 370 aa, Saccharomyces cerevisiae
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLEFDENVELGHLSPDELSSVKKKLYPKSK

SEQ ID NO: 17060 - protein, 335 aa, Nepenthes alata
YQWAFAIAAAGITSGSIAERTQFVAYLIYSSFLTGFVYPIVSHWFWSVDGWASASRASNLLLGSGVTDFAGSGVVHMVGGVSGLWGALIEGPRIGRFDRSGRSVILRGHSGSLVVLGTFLLWFGWYGFNPGSFLTILKAYGNNGGYFGQWSAVGRTAVTTTLAGSTAALTTLFGKRLLVGHWNVTDVCNGLLGGFAAITSGCSVVDPWAAIICGFVSSWVLIGFNKLAEKVKYDDPLEAAQLHGGCGMWGLIFTGLFATKKYVSEVYGGSPDRPHGLFMGGGGKLLAAQLIQIVVIFGWVTATMGPLFYGLKWLKLLRVKSEHEMAGMDMTSHGG

SEQ ID NO: 17061 - protein, 520 aa, Gossypium hirsutum
MVGNSLAGLQDHLKLAREYALEGLYDTSIIFFDGAIAQINKHLNTLDDPLIRSKWMNVKKALSEEAEVVKQLDAERRSFKEAPNGRRPSSPPIHAKSSFVFQPLDEYPTSSGAPMDDPDVWRPPSRDTSTRRPARGGQAGMRKSPQDGISGRGSTRTAATGRGAKAGASSRTNTGVRGSTTGKKGTGSGKPSKGDSANGDAEDGKSKRSQYEGPDPDLAEMLERDVLETTPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQVDGVNNTGTNEDGSRKIVMVLAATNFPWDIDEALRRRLEKRIYIPLPNFESRKELIRINLKTVEVAADVDIDEVARRTEGYSGDDLTNVCRDASLNGMRRKIAGKTRDEIKNMSKDEISKDPVAMCDFEEALAKVQRSVSQADIEKHEKWFSEFGSA

SEQ ID NO: 17062 - protein, 289 aa, Sphingomonas paucimobilis
MTIKPLRKAVFPVAGLGTRFLPATKAMPKEMLPVVDRPLIQYAVDEAVEAGIEQMIFVTGRGKSALEDHFDIAYELEATMAARGKSLDVLDGTRLKPGNIAYVRQQEPMGLGHAVWCARDIVGDEPFAVLLPDDFMFGQPGCLKQMVDAYNKVGGNLICAEEVPDDQTHRYGIITPGTQDGVLTEVKGLVEKPAPGTAPSNLSVIGRYILQPEVMRILENQGKGAGGEIQLTDAMQRMIGDQPFHGVTFQGTRYDCGDKAGFIQANLAVALSRPDLEPAVRAFAVKALG

SEQ ID NO: 17063 - protein, 195 aa, Daucus carota
MGGGDGHNDQDKGLFSNLAGGLAGGGHYPPGQYPPAAGGYPPQGYPPAGGGYPPQGYPPAGGGYPPQGYPPAGGGYPPQGYPPAGHHSGSSAPHHSGHGGVAGMVAGGRAAAAAAYGVHHMTQGHGSHGGHGGYAHGAMGMMPGMGAMAMASSSTVSTVMESLSRESTGRARSTDTRSGSNLSFSISSRTFWATK

SEQ ID NO: 17064 - protein, 213 aa, Glycine max
  unsure (1)..(213): unsure at all Xaa locations
MDTKSAVELMESSAEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTEQLLRVMDKLKHGEAVDIPKYDFKSYKSDDMLRRVNPSDVIILEGILVFHDPRVRXLMNMKIFVDTDADVRLARXIRRDTTEKGRDIGAVLDQYXKFVKPAFDD

SEQ ID NO: 17065 - protein, 249 aa, Xylella fastidiosa Ann-1
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 17066 - protein, 472 aa, ASPERGILLUS NIDULANS FGSC A4
MAPHANLDVAANGAVNGSAQTARAPLFTVNSPNVEYTETEIKSTYAYHTTDVTRSAEGKLIATPKAATYHFKVDRKVGKVGLMLVGWGGNNGSTVTAGIIANRRKLSWETKEGPRAANYYGSLVMSSTIKLGTDSKTGEEINIPFNDMLPMVHPNDLVIGGWDISSMNLADSMDRAQVLEPTLKQLVRKEMAEMKPLPSVYYPDFIAANQEDRADNVLEGSKASWAHVEKIQADIRNFKAENGLDKVIVMWTANTERYADILPGVNDTAENLVNSIKSGHTEVSPSTVFAVACILDNTPFINGSPQNTFVPGAIELAEKHNAFIGGDDFKSGQTKMKSALVDFLINAGIKLTSIASYNHLVGDNKRALDEYYAEIFMGGHQTISLFNICEDSLLASPLIIDLVVLAEMMTRITWKADDAAEYKGFHSVLSVLSYMLKAPLDPSWYSGCQLLGKAAQRFDQHLPRLRWIAARV

SEQ ID NO: 17067 - protein, 125 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 17068 - protein, 462 aa, Pelagococcus subviridis
  unsure (1)..(462): unsure at all Xaa locations
GYWDANYAVKATDLLALFRITPQPGVDPVEAAAAVAGESSTATWTVVWTDLLTACDIYRAKAFRVDPVPSAPDQFFXYXAYEGDLFRXGSLANMTASIIGNVFGFKAVKALRLEDMRIPHSYLKTFQGPASGVVVERDVXTKFGRPLLGATVKPKLGLSGKNYGRVVFEGLKGGLDFLKDDENINSQPFMRWRERFLYCVEGINRAAAATGEVKGSYLNMTAGNNDEMITRGEYAKEIGSVIVMIDLVIGYTAIQTAAIWARSNDMILHLHRAGNSTYARQKNHGINFRVICKWMRMAGVDHIHAGTVVGKLEGDPLMIQGFYDTLLKTKLAIDLPKGIFFDMDWASLRKCLPVASGGIHCGQMHQLLNYLGDDVXXXXXXXXXXXXXXXXXGATANRVALEAMVLARNEGRDYIEEGPQILRDTAKMCGPLQTALDLWKDISFNYASTDTADFADTPTANV

SEQ ID NO: 17069 - protein, 323 aa, Streptomyces coelicolor A3(2)
MDTRPLVSTPFTASSTADEVLEDVDLTGVRAIVTGASSGLGIETARALTAAGAEVTLAVRNTAAGASAAETIARSTGAAPPRVVRLDLADRAGVTRFVDAWDGPLHLLVNNAGVVTGGLERTPEGWELHFATNHLGHFALATGLHQALARGAAERGGARIVSVSSTAHMRSGIDFDDLHFERRSHDPQTAYAQSKTANSLFAVEATRRWGSAGIVANAVNPGGVATGLQRNFTPEQKASLDAAEAAGVFTYKTVEQGAATSVVAAVAPEFAHSGGHYLDDGQEAYTVPNDADLAQHPHGVKEWALDPAAAKRLWTVSTDLLRS

SEQ ID NO: 17070 - protein, 490 aa, Bacillus subtilis subsp. subtilis str. 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 17071 - protein, 308 aa, Zea mays
MKSYPWAGARPLAVVQLLLFLAHLVDRGGAAGGGSKGSSVYPAAVVYPHHSRQISCKPRVFLYQHFLSDDEANHLISLARAELKRSAVADNMSGKSTLSEVRTSSGTFLRKGQDPIVEGIEDKIAAWTFLPKENGEDIQVLRYKHGEKYEPHYDYFTDNVNTVRGGHRYATVLLYLTDVPEGGETVFPLAEEPDDAKDATLSECAQKGIAVRPRKGDALLFFNLNPDGTTDSVSLHGGCPVIKGEKWSATKWIRVASFDKVHHPQGNCTDENESCAKWAALGECIKNPEYMVGTTALPGYCRRSCNVC

SEQ ID NO: 17072 - protein, 2444 aa, ASPERGILLUS NIDULANS FGSC A4
MGRLQLSSGLKAIALLTFAATATCWPYDESLVDYNVNTNKSATNPADYWGEWSDHKYHPSPENWRFPFYTLFMDRFVNGDPTNDNINGTTFEHDLNSNQMRHGGDVAGLVDTLDYLQGMGIKGLYLAGTPLMNQPWGSDGYSALDTTLLDQHFGTIQVWRDAITEIHKRGMYVLFDNTIATLGDLIGFEGHLNDTTPFSEKEHKALWKSNRRYVDFDIGNTYNATCDYPRFWYEDGMPVNESLTAGLVGCYDSDFDQYGDIEAFGVWPDWKRQLAKFASVQDRLREWYPPVRERLIRHTCMIIASFDIDGIRYDKATQATVDALGDMSKAYRECARAVGKENFFIAGEITGGNTFGSIYLGRGRQSNQVDSVGNIYDAMKLTNESDPQLFLREVGHEAIDAGAFHYSTYRALTRFLGMDGQLEAGYDVPLDWVQAWGNMTVTNDLINANTGKFDPRHMYGVTNQDVFRWPAIEWGVERQMLGSFITTLMLPGIPLLLWGEEQAFYVLDATASNYIYGRQAMSSATAWKTHGCFSLESSQYYQWPLVAALDGCNDETVTYDHRDPSHPVRNIIKHMYQMREQYPMLNDGFIIETLSNQTEPVYYPGSNGTETETGMWSVRRDRNEETQDFGSSDDNEPIWLVYSNMNRTHDYTFDCSDNETALIAAFPSGTKVRNLFHPYDTLTLGDGPKEMVYGNSTELVGCLPNLTLSRYEFRAYVKNELWKKPRPMITKFQPGDDEANGHDSPLRSTVAPDASETVRLTLQFSEAMGCDSVTDSISFNSSTETGKIPSIDASTVQCGNITEVANSNATGHIPGKWQWAADLRGVYNGIHRVTVNNASNADGDDSTHAVDHFLFRIGQIDNPMVFTSANYSSSLLHEKEDGTFYIQHHAAGADKYRYSTNWGTTFSDWKTYKGGNDTITMLPWNGTKAQEWEGHHIRVEYWSRWTGSSSHVQEGDSGWKYKTPRRFPHAFFNGPYNQYGYDGGLDNQIKLDAGAGGDGYWKYHFTSEWPAVGQVNVWGINPDGEPDQSWVMGDVDGDKVLDRMPPSALSATLINITDHPTHPYISWKLYINDATMRYYLIPAGHQSGQIAMFVLFWIIPLLSGSACVYIFMKSFYKVKFNEIGAAGASTEMKSLVPLALRRRMKQLASGNGKNGPSFNPLMRLAEKSGFMQSTTALAGAASGKRRMVLIATMEYDIEDWGIKIKIGGLGVMAQLMGKTLGHQDLIWVVPCVGGVDYPVDTPAEPMTVTILGQAYQVNVQYHVLKNITYVLLDAPVFRQQTKSEPYPARMDDLDSAVYYSAWNQCIAEAIKRFPVDLYHINDYHGSVAPLYLLPGTIPACLSLHNAEFQGLWPMRTQKEKEEVCSVFNLDVEVVRNYVQFGEVFNLLHAGASYLRVHQQGFGAVGVSKKYGKRSYARYPIFWGLRKIGNLPNPDPSDVGEWTKEDSLIKDEDIKVDPEFEAGRAELKRQAQEWAGLDQNPDADLLVFVGRWSMQKGVDLIADVMPAVLEARPNVQLICVGPVIDLYGRFAALKLDRMMKVYPGRVFSRPEFTALPPYIFSGAEFALIPSRDEPFGLVAVEFGRKGALGIGARVGGLGQMPGWWYNVESVSTSHLLMQFKLAIEAALSSKTETRAMMRARSAKQRFPVAQWVEDLEILQSTAIQVHEKEVSRGHAGGRPMTPMTPSGATTPSGMMTPTTGSRGLKPLSQGVGMGLSVPHSRESSYSNLNRLSEYVAQKTPGESQPRESSGLQRSLSLGVRSGPGHRGRARKQKPGADNIPEGNEDGSSSDTESIPDYYDDEYTLTPAQIEESRRAQATRSISFSPETLQPPRSPLPAPPMSPGTPPSVEQTLLPPPKPFAAADAGNRLSSASVLSLDSVVGGKKDFKLQKVDPFFTDSNGEYARNFEQQLENLNGSNSESQLCIEEFLVKSERRWFNKFRDARLGRLRSPTPSVFRDNHSHGRGSPDGSMYVDEAGHRNSGDAVHDNGSDDTDDEFLLGKDYVPPTGLKKWMQIKIGDWPVYTLFLALGQIIAANSYQITLLTGEVGQTAEKLYGIATTYAITSALWWLVFRYFKSIVCLSTPWFLYGIAFLFIGSAHFESDSFTRGWIQNVGSGFYAAASSSGSIFFALNFGDEGGAPVSKWIFRACVIQGIQQVYVIVLWYWGSTMAHQSSQGLLTADNTISNTWKMTAICYPIAMLLWAIGLLLIFGLPNYYRQKPGKVPSFYKSLFRRKIVLWNFVAVILQNFFLSAPYGRNWSFLWTSSHTKPWQIVILCVIFFGLLWCAFLYIVAVLSKQHSWFLPVFACGLGAPRFLQIWWGVSGIGHYLPWVAGGYTGGALVSRSIWLWLGVLDSIQGLGFGIILLQTLTRMHMCFTLIVSQVLGSIATIVARACAPNNVGPGPVSPDITKGAGELANAWFWVALFCQLLVCAGFLLFFRKEQLAKP

SEQ ID NO: 17073 - protein, 453 aa, Corynebacterium glutamicum ATCC 13032
MSNRHLQLIAIGGAIGTGLFMGSGKTISVAGPSVILVYAIIGFMLFFVMRAMGELLLANLNYKSLRDAVSDILGPGAGFVTGWTYWFCWIATGMADIVAITGYTQYWWPEIPLWLPGVLTIALLFALNLAAVRLFGEMEFWFAIIKIVAIVSLIVVGLFMVVTAFESPNGTTAQFNNLIEHGGFFPNGITGFLAGFQIAIFAFVGIELAGTAAAETENPTKTLPRAINSIPIRIVVFYVLALAVIMMVTPWDQVRADNSPFVQMFALAGIPAAAGIINFVVITSAASSANSGIFSTSRMLYGLSLEGAAPKRWSRLSKNLVPARGLTFSVICLIPAVGLLYAGGTVIEAFTLITTVSSVLFMVVWSYILVAYIVYRRNSPELHKKSIFKMPGGVVMAVVVLVFFAAMLVVLSLEPDTRAALIATPVWFIILGIGWLSIGGAKGAKHRSQITSH

SEQ ID NO: 17074 - protein, 482 aa, Austrofilum incommodum
NRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHMKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEIATETR

SEQ ID NO: 17075 - protein, 246 aa, Keteleeria evelyniana
YTYTLRKKGPEDVILRVLYCGICHSDLVHMHNEFGMSRYPLVPGHEVVGIVTEIGSEVKKFKVGEHVGVGCIVGSCRSCGNCNQSMEQYCSKRIWTYNDVNHDGTPTQGGFASTMVVDQMFVVRIPENLPLEQAAPLLCAGVTVFSPMKHFGMTEPGKKCGILGLGGVGHMGVKIAKAFGLHVTVISSSDKKKEEALEVLGADAYLVSKDAEKMQEAAESLDYIMDTIPVAHPLDPYLSLLKTNGK

SEQ ID NO: 17076 - protein, 446 aa, Zea mays; identical to SEQ ID NO: 8390

SEQ ID NO: 17077 - protein, 542 aa, Oryza sativa
  unsure (1)..(542): unsure at all Xaa locations
MGRQDQQLQVLNALDAAKTQWYHFTAIIVAGMGFFTDAYDLFCISLVTKLLGRIYYTDPASPTPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGXVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 17078 - protein, 245 aa, Nicotiana tabacum
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKGRLEVLQRNQGHYAGEDLDSLCMKELQNLEHQLDSALKHIRSRKNQLMHESISELQKKDEALQEQNNNLSKQVKEGEKELAQQTQWEQQSHDHLNSSSFVLTQPLSSLHLGEAYPTAGDNGELEGSSRQQQQNTVMPPWMLRHLNG

SEQ ID NO: 17079 - protein, 127 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 17080 - protein, 222 aa, Coxiella burnetii RSA 493
MNKKIISASILSADFSRLGEEVKSVIQAGADNIHFDVMDHHFVPNLSFGAVVCKALRDAKITAPIDVHLMVKNPNEFIKPFAEAGANLITFHPETVKDVEDTIARIKKAGMQVGMAFNPEKSLSLFTSFLTKIDLVLLMSVNPGFAGQSFMAESLKKIAATRQLLDTLQSKAFLGIDGGIKINNIADVSRAGADFFVVGSGLFHSSNYEEKLKEMRHAINDR

SEQ ID NO: 17081 - protein, 331 aa, Gossypium hirsutum
MASASTWILSLKLLLISTGILGIALGLKISVPLVLEFSVSQAPLWWSGFRSWLKPPYLYVVINGIIITIAASSRFNQNNGEKDQMEQMQPRPKISEDQQPIVEYDTKSGWGSDAVESSDFVYEENQRGEEVATRVSEEESNVAVEDDRDGNEFVISKSEWIPPSRTDSSEIPLDALLIQEKPAPSSRSGHRKPVKVNPEGGRALKAAKPKRHETLENTWKMITEGKSMPLSRHLKKSDTWENHGRDINVEALTSSPLMKKSETFRDRTNYQLPPEQVSSFPASGKLRKEPSLSQDELNRRVEAFIKKFNDEMRLQRQESLNQYMEMVNRGS

SEQ ID NO: 17082 - protein, 215 aa, Fusobacterium nucleatum subsp. vincentii ATCC 49256
MTNGIKIAPSILSSDFSKLGEEVVAIDKAGADYVHIDVMDGQFVPNLTFGPPVIKCIRKCTELVFDVHLMIDKPERYIEDFVKAGADIVVVHAESTIHLHRVIQQIKSFGVKAGVSLNPSTPEEVLKYVINDIDMVLVMSVNPGFGGQKFIPAVVEKIKAIKKMRADIDIEVDGGITDETIKVCVDAGANIFVAGSYVFSGNYKERIDLLKIKAK

SEQ ID NO: 17083 - protein, 392 aa, Bacillus cereus ATCC 14579
MKLFQPSEIVTSLPTQFFASLVAKVNKVVAAGHDVINLGQGNPDQPTPQHIVKALQDAAEKTIHHKYPPFRGHESLKEAVATFYKREYGVELNPKTEVAILFGGKAGLVELPICFTNPGDTILVPDPGYPDYLSGVALAKAHFERMPLIAENNFLPDYTNIDASIAERAKLMFLNYPNNPTGATASKDFFDETIYFANKHNILVVHDFAYGAIGFDGQKPVSFLQADGAKDIGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 17084 - protein, 316 aa, Escherichia coli
TDKLTSLRQYTTVVAATGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 17085 - protein, 422 aa, Zea mays
MATKYAAAAADLVTGRPRKRARLGWDVASAAEAQIGTFCGQEVGDVASLLLSANPSDHTCSSLLPKGVARNASPPWREDDKDGHYVFAVGENLASRYKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCSGETLFQTHDNLEHLAMMDRVLGPLPRHMLERADQHAEKYVRKGGLNWPQAITTVESVRAVLKLPRLQNLVMQHVDHSAGDFIDLLKRLLAYEPSGRLTAQEALGHVFFTRYRQ

SEQ ID NO: 17086 - protein, 313 aa, Medicago truncatula
MDSFPIINLENLNGDERKATMEKIKDACENWGFFELVNHGIPHDLMDTVERLTKEHYRKCMEQRFKELVSSKGLEAVQTEVKDMDWESTFHLRHLPESNISEIPDLSDEYRKSMKEFALKLETLAEELLDLLCENLGLEKGYLKKALYGSKGPTFGTKVANYPPCPKPDLVKGLRAHTDAGGIILLFQDDKVSGLQLLKDGNWVDVPPMHHSIVINLGDQLEVITNGKYKSVEHRVVAQTDGTRMSIASFYNPGSDAVIYPAPTLIEENNEIYPKFVFEDYMNLYARLKFQAKEPRFEAFKESNVNLGPIATV

SEQ ID NO: 17087 - protein, 250 aa, Glycine max
  unsure (1)..(250): unsure at all Xaa locations
CFDLILLQNGTTEEVKKIVTTLNEAKVPGEDVVEVVVSPPFVFLPVVKSLLRPDFHVSAQNCWVRKGGAYTGEVSAEMLVNLGIXPWVIIGHSERRQLLNESNEFVGDKVAYALQQGLKVIACIGETLEQREAGTTTAVVSEQTKAIAAKISNWDNVVLAYEPVWAIGTGKVATPAQXAQEVHADLRKWVHDNVSAEVAASVRIIYGGSVNGGNCKELAAQPDVDGFLVGGASLKPEFVDIINAATVKKN

SEQ ID NO: 17088 - protein, 294 aa, Yersinia pestis CO92
MSFFHANQREALNQSLSELQGQINVSFEFFPPRTSEMEDTLWSSIDRLSTLKPKFVSVTYGANSGERDRTHSIIKGIKERTGLEAAPHLTCIDASPTQLRDIAIDYWNSGIRHIVALRGDLPPNSGKPEMYACDLVGLLKDVGDFDISVAAYPEIHPEAKSAQADLINLKRKIDAGANRAITQFFFDVESYLRFRDRCVATGIDVEIVPGILPVSNFKQLQRFATMTNVRVPNWMTSIFDGLDNDPETRKMVGASVAMDMVKILSREGVKDFHFYTLNRAELSYAICHTLGVRP

SEQ ID NO: 17089 - protein, 325 aa, Glycine max
SARGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 17090 - protein, 709 aa, Emericella nidulans
MAEQRLKAAILVVSDTAFQDPSSDRVFGTLIDVFPADGPWEKPITKIVPDDVLQIQRAVCDWTDSPSPVNLVLISGGTGFAVKDNTPEAVTPLLHRHAPGLVHGMIAASLKVTPFAMMARPVAGTRHKSLVITLPGSPKGAKENLEAVIKLLPHACTQAAGADSRTLHAGGIKKLEAEAGVKSESQHDHHHHHHHEHTHSHSHSHGHGHGHVVPRAHTTPSERRSNDPAAGATRRYRESPYPMLSVDEALRQVSAHTPEPEVIEVPVNIDLVGYVIAEDVYAAEAVPAYLASIVDGYAVIAPESPDDGHSTKGIFPVASITHANEEGALAPLEPGTIARITTGAPLPPNANAVVMVEDTLLASSTPDGKEEATVEILTGEIKPNENVRQPGSDVALGSRILQRGDLITPVGGEIGLLAATGTRTVKVFKKPVVGVLSTGDELVEHDDPRSLQGGQIRDSNRPSILSCLKSWGIPAVDLGIARDTPAGELEQSLRDALRGVGKSNTSVDVIITTGGVSMGELDLLKPTIERSLGGTIHFGRVSMKPGKPTTFATVPFKPTSSAAGQQERSSRLIFSLPGNPASALVTLNLFVLPSLHKLIGLGQKQAALGIAPALGLPLVAVTLSHAFPLDPKRTEYHRAIVTASPKDGRLYATSTGAEGVGQRSSRVGSLASANSLLVLQPGKGSIAQGSLVEALMMGPIVREGAAVAL

SEQ ID NO: 17091 - protein, 159 aa, Nicotiana tabacum
MAMIPSFFGGRRSNIFDPFSLDIFDPFEGFPFSGTVANVPSSARETSAFANARIDWKETPDSHIFKMDVPGIKKEEVKVEVEEGRVLQISGERSREQEEKNDTWHRMERSSGKFMRRFRLPGNAKMEEIKAAMENGVLTVTVPKEEEKKSEVKAIDISG

SEQ ID NO: 17092 - protein, 221 aa, Zea mays
MSEVFEGYERQYCEASASLSRKCTAASALDGEKKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALVLAILLILYFKLAN

SEQ ID NO: 17093 - protein, 222 aa, Stellaria longipes
MAKARIGHFVEAQILESIGVDYVDESEVLTPADEDHHINKHNFQIPFVCGLSIPRGAPPPAYRRGYAGHDTGPRVRKPSTGNVVEAVRHIRSVMGEIRLLRNMDDDEVFAYAKKISAAYDLVMQTKQLGRLPVVNFAAGGVATPADAALMMQLGCDGVFVGSGVFKSGDPAKRARAIVQAVTHYSDPDLLGRGEFGLGEAMVGIIVRMRRLRGTPIVLNEVI

SEQ ID NO: 17094 - protein, 336 aa, GIBBERELLA ZEAE PH-1
MVSNTELPSRMRAAYIAQHNKPYALGDRPLPFIRDTDILVRVHAAGFCHSDLQALRGEFEKPAPIGLVPSHEIAGTIAKIGSSYRGDLKVGDRVGILNFKHACGSCVGCRLTTRKGEKLDPRFCNDRETAGFLHDGGFADYASADPETTVRLPDSISFQQAAPLTCAGATVWASLEAATSGLSKGETVAIVGIGGLGHLGVQFAKALGFRTIAVDSRQAGRKLAEEVENHKLKPDLVVDSSDTDCASNIIYDFTKGEGVAAAVVCTPSLEANRWALTILRIKGTLGILGLPQNPWQFDAAPLVFKELSIKSNYVAGKEATDRMMRILYRLTGSPAL

SEQ ID NO: 17095 - protein, 337 aa, Nostoc punctiforme
MSILGSAISVMTSQVNQRDLEIDSSPLLAVLQELHSQYKLLQEGAVAKYIPELAKVNPDLFSICIVTVDGQIYKVGNYDQLFTIQSISKVFAYGLALEDHGLDYVLTRVGVEPTGDAFNAIVLDEQSKRPYNPMVNAGAIATTSLIKGSGPTERLNRMLDMYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAKSGVCGGIIAVVPNKMGIGVFSPLLDVRGNSVRGVKVCEELSQRLGLHLFDCSGQEAKFD

SEQ ID NO: 17096 - protein, 533 aa, Rhodospirillum rubrum
MVVSDLLARTLPIPVPRPLYQIALGGVIGLFADLRVVLEPDIFFLLFLPPLLFLDGWHIAREEVFKDRFVILELAFGLVFLTVLGAGLFIHWMIPAMPLAVAFALAAVVSPTDPIAVSAIAKHAPIPKRMMNILEGESLLNDASGLVCLRFAVAAALTGGFSLTDAALEFLWVALAGIAVGISLTWAVTRSKNMLARRIGESSATQTLISLLIPFGSYLVAEHLDCSGILAAVAAGVTMSIEESSGQAQAATRIRRNTVWDTIQFAANGVIFVILGEQLPAILESAAETVRVTGHHEPWWLGIYVVAICLGLAALRFLWVWASLQVSLLRTGQKRPPRHWRLITAMSLSGVRGAITLAGVLTLPLTMTDGTAFPARDLAIFLAMGVIIVTMVVATVFLPLLLNGLEMSQDSTADDQEAAARIAAAEVAIAEIERVQHSMAEGAKDADLFVTVGASLMDVYRERVRSRSQEGEAAVLVRRVDWIEREMRLAALRAERSEIFRRVRKYQLGSERARKLIRELDLLETRYSAEPKG

SEQ ID NO: 17097 - protein, 243 aa, Glycine max
MMSSFVVLHGLHGSLLRSQFLGQDTLTHLYPRNKASTIHNKPTTAQPRAKFDMLQVLGGRGLCNGEAGLKQELKRELGVDEKAPASATSDKEQELEEESSTTQSLASVAAEDGFEKELMGLTGGFPGGEKGLKKFIQENPPPLKPSQGSKSLKLALSKKPKPPELPLLLPGMIAIVKNPNNPFYMYCGIVQRITDGKAGVLFEGGNWDRLITFRLEELERREKGPPMKNPKSAVLEPFLEKKS

SEQ ID NO: 17098 - protein, 559 aa, Staphylococcus epidermidis ATCC 12228
MKNNSKSKSNKISLSQLVLLGLGSLIGSGWLFGAWEASSMAGPAAIISWVIGFLVIGTIAYNYIEIGTMFPQSGGMSNYAQYTHGSLLGFIAAWANWVSLVTIIPIEAVSAVQYMSSWPWDWAKPMGSLMKDGSISTYGLIAVYIIIAIFSLLNYWSVKLLTSFTSLISVFKLGVPILTIIMLLVSGFDTGNYGHSIGTFMPYGSAPIFAATTTSGIIFSFNAFQTIINMGSEIKNPEKNIARGIVISLTLSAILYIVLQSTFITSMPSSMLHEHGWSGINFNSPFADMAILLGLNWLAILLYMEAVVSPFGTGVSFVAVTGRVLRAMEENGHIPKFLGKINKKYNIPRVAIAFNAIISMVMVTLFRDWGTLAAVISTATLVAYLTGPTTVISLRKMAPKMTRPFKANILKFMAPLSFVLASLAIYWAMWPTTAEVILIIILGLPIYFFYEYKMNWKNTKKQIGGSLWIIIYLIVLAFLSFIGSKEFKGLNWIHYPWDFLVIVIVALIFYQLGTTSYFESIYFKRANKLNKKMGDKLRKTRKKARHKDWKERDRQEQNQ

SEQ ID NO: 17099 - protein, 214 aa, Staphylococcus epidermidis ATCC 12228
MVKILPSLLSIDFLNLKEELQLLETAKVDGLHFDVMDGKFVPNISIGIPILDAVRQQSHLPIDVHLMIEQPENYINLFAEHGADMISVHVESTTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 17100 - protein, 497 aa, Salmonella typhimurium LT2
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQKMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 17101 - protein, 219 aa, Triticum aestivum
  unsure (1)..(219): unsure at all Xaa locations
NLTSPVVLDDFRCPISLDLMKDPVIVSTGQTYERGCIERWLEAGHNTCPKTQQKLLNKSLTPNYVLRSLIAQWCEANGVEPPKRPAQPNNTPATCTASEHSKVIELLQKLSSQNLADQRGAAGMLRQLAKRSAENRACIGEAGAIPILVSLLPTTDVSTQEHVVTALLNLSIYEENKARIITSGAVPGIVHVLKRGSMEARENSAAXTLFSLSLVDXNK

SEQ ID NO: 17102 - protein, 363 aa, Buchnera aphidicola str. APS (Acyrthosiphon pisum)
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGE

SEQ ID NO: 17103 - protein, 254 aa, Brucella melitensis biovar Abortus
MKAMVLEKPGQPLVLVERPDPLPGPGQIRLKVEACAVCRTDLHVVDGELERPKLPLVPGHEIVGVIDAVGTGVDPSRTGRRVGVPWLGHTCGACDYCRSGAENLCDAPLFTGYTRDGGFATHVVADADFAFDLDEAADPVALAPLLCAGLIGWRSLKKAGEGKRIGLYGFGAAAHIIAQVCRWQTGRFTLSQSPEIRKRKILRAALARYGPEIQIFCRRHRWMQLSFSHPPGSSFQPPCVRCARAAGWSAAASI

SEQ ID NO: 17104 - protein, 519 aa, Glycine max; identical to SEQ ID NO: 16899

SEQ ID NO: 17105 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 17106 - protein, 306 aa, Photobacterium profundum
MEFIMTKTSLVRKAVIPVAGLGTRMLPATKAIPKEMLPIVDRPLIQYVVNECVAAGIKEIILVTHSSKNSIENHFDTSFELEATLEKRVKRQLLEEVQSICPKDVTIMHVRQGQAKGLGHAVLSARPLVGDEPFAVVLPDVVLDDAASDLRTENMAAMIAAFNETKISQVMVEPVPMADVSSYGVADVNGVGLKPGETAAMTKVVEKPALEDAPSNLAIVGRYVLPAEIWGMLERTPVGAGDEIQLTDAIDMLMESQQVNAFHMSGKSHDCGTKLGYMQAFVEYGMRHNSLGDDFKAYLKDMVKTL

SEQ ID NO: 17107 - protein, 158 aa, Coccidioides immitis
GAFDNERVVLPLTQYDVVIDRDSPRPGQQAFEKMTAGLYLGEIFRLVLLDLIDNKGNLIFEGQDVSSLRKPYCLDSSFLAYIEEDPFENLSETRDLFERTLGIKATKPELELCRRLAELVGTRAARLSACGVAAICKKKNIKSCHVGADGSVFNKYPH

SEQ ID NO: 17108 - protein, 571 aa, Buchnera aphidicola
MEILSGAEMVVRSLINQGIQHIFGYPGGAVLDIYDALKTIGGIEHILVRHEQAATHMADGYARSTGKTGVVLVTSGPGATNAITGIATAYMDSIPMVVISGQVASLLIGYDAFQECDMIGVSRPIVKHSFLVKKTEDIPITFKKAFWLAESGRPGPIVIDLPKDILKKKSKYFFKWPDSVNIRSYNPTTKGHKKQIQKALYRLLKAKQPVIYAGGGVISSKCHKELLEFAEKTNCPVTTSLMGLGVFPGNHPQSIAMLGMHGTYEANMAMHHADVIFAIGVRFDDRTTNNLKKYCPNAIVVHIDIDPTSISKTVSAHIPIVGDAKYVLQQMLKILKSEQHIFCLKNWWNCIEKWKKVNSLKYYENNKKIKPQKVIETLFQLTKGDAYITSDVGQHQMFTALYYPFNKPRRWINSGGLGTMGFGFPAALGVKLGFPKDTVICITGDGSIQMNIQELSTARQYNLAILIINLNNASLGMVKQWQDMIYCGRHSHSYMDSLPNFIQLVESYGHIGIQISQPLELKEKLILALQKLSTGNLVFVDIKIDSSEHVYPMQIQGGGMNDMWLRKKEEF

SEQ ID NO: 17109 - protein, 317 aa, Escherichia coli
  unsure (1)..(317): unsure at all Xaa locations
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIXLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 17110 - protein, 264 aa, Bacillus anthracis str. A2012
MTGRLQNKVIVITGASSGIGEQVAMQVAEQGATPVLMARTEEKLKALADKIKETYNTPCYYYVLDVSEETEVQSVFSKVLQEVGRIDILVNNAGFGIFKTFEDASMDEVKDMFQVNVFGLVACTKAVLPYMVKRNEGHIINIASLAGKIATPKSSAYAATKHAVLGFTNSLRMELSSTNVFVTAINPGPIDTNFFEIADQSGTYVKNMGRYMLKPTYVAEQIVKSMQTKKREVNLPKWMGIGPKLYALFPGLFERVAGKSLSKK

SEQ ID NO: 17111 - protein, 642 aa, Nostoc sp. PCC 7120
MVQTPPSQFSEEQYKIENANAEVQALIESPTPETEIDLEFLYTRDIEFRQETIYFLVVDRFYDGDPENSEGYNPELYDPNGEDWGKYWGGDLQGVIDKLDYLKDMGVTALWLTPLFEQVEELFVGNAAMHGYWTKDFKRLNPRYIGKDENPSLNNTQETRNTTFDRLVTELHKRKMKLILDIVCNHSSPDTSGSKGELYDDGVKIADFNNDVNHWYHHYGEVEDWEDDWQVQNCELSGLATFNENNTEYRQYIKLAIKQWLDRGVDALRVDTVKHMPIWFWQEFTGDMYNHKPDVFIFGEWIYNHPSDDLSVEFANNSGMTLLDFGLCVAIRGALAQGAEGGFHLIQEVFDQDYRYNGATELITFVDNHDMPRFQSLNPDPAMLKVAIALIMTSRGIPCIYYGTEQYLHDDTNGGNDPYNRPMMGNWDTDTEVYRYLRLLSGIRRLNPAISMGSQWQKYLTSDVYCYVRRYRSSVCFVALNRGAELILPEVQTDLPDGEHTCAVTRNKFEVKDGKIYNLQLEERGVMVLSHVGERVKAQTIVRVQLNGVHTQPGETIVVVGDCPELGNWDISKAYPLEYINSNTWFAEIPFDESAGKLISYKYAMWREGRSPLRENILNRRWVVAKEGTVKWRDTWASGRES

SEQ ID NO: 17112 - protein, 196 aa, Zea mays
YTSDVNIVSNASCTTNSLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDRVSTDFTGDSRSSIFDAKAGIALNDHFIKLVSGDDNEWGYSNRVVDLIRHMFKTQ

SEQ ID NO: 17113 - protein, 204 aa, Oryza sativa
  unsure (1)..(204): unsure at all Xaa locations
MAGEVAIDSGEKRLNELGYKQELRREMTLFKTLAISFSTMTLFTGITPLYGSSLRYTGPASLVWGWVIVWFFTLLVGFALAEFCSSFRTTGSLHFXAAHLAGPVWAPARSPWSAAFEAIPPTPGACAQPFPGSPLLSRIILLCTFTCFARGYLAPPRLSRLLACGRAGFAAARCPLPPGVLAPLDLISMWWQVIGGTVIVIVLP

SEQ ID NO: 17114 - protein, 713 aa, Pseudomonas fluorescens PfO-1
MSTKKPANDKSQLAGTDTPDRANTNAKLDSLEKFRSDATGQALRTNQGVKVADNQNTLKAGARGPSLLEDFIMREKITHFDHERIPERIVHARGTGAHGFFQSYENHSTLTKAGFLQDPGKKTPVFVRFSTVQGPRGSGDTVRDVRGFAVKFFTDEGNFDLVGNNMPVFFIQDAIKFPDFVHAVKPEPHNEIPTGGSAHDTFWDFVSLVPESAHMVIWAMSDRAIPKSLRSMQGFGVHTFRLINAEGKSRFVKFHWRPTAGTCSLVWDEAQKLAGKDTDYHRRDLWEAIEMGDYPEWELGVQVIEEENEHDFDFDILDPTKLIPEEIVPITPLGKMTLNRNPDNFFAETEQVAFCPGHIVPGIDFSNDPLLQGRLFSYTDTQISRLGGPNFHELPINRPVAPFHNGQRDAQHRTVIDKGRASYEPNSIDGGWPKETPPAAQDGGFESYPERIDANKIRQRSESFSDHFSQARLFFNSMSAHEKEHIIAAYSFELGKVEREFIRARQVNEILANIDLELAKRVAANLGLPAPGKGTVDVPKTSLDRSPSLSQANLLPENIKTRKVAILAANGVDGAAIDAMKKALAAEGAHAKLLGPTSAPVKTADGKSLAVDASMEGLPSVAFDAVFVPGGAASVKALSGDGVALHYLLEAYKHLKAIALQGEAKQLLDVLKLEADAGLLEGKDVGALTKPFFSAIGQHRVWDREAKAKAIPA

SEQ ID NO: 17115 - protein, 348 aa, Erwinia chrysanthemi
MERWFKSLFVLVLFFVFTASAADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTY

SEQ ID NO: 17116 - protein, 95 aa, Brassica oleracea var. capitata
MGRGRVEMKRIENKINRQVTFSKRRAGLLKKAHEISILCDAEVSLIVFSHKGKLFEYSSESCMEKVLEHYERYSYAEKQLKVPDSHVNAQTNWSM

SEQ ID NO: 17117 - protein, 459 aa, Pterocladiella bartlettii
DPDYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVFEGLRGGLDFLKDDENINSQPFMRWKERFLYSMEGVNRSIASTGEIKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIKGFYNTLLLPHLDVNLPQGIFFEQDWASLRKVTPVASGGIHCGQMHQLLDYLGEDVVLHFGGGTIGHPDGIQAGATANRVALEAMVIARNEGRDYVAEGPQILRDAAKTCGPLQTALDLWKDITFNYTSTDTADFVETPTANV

SEQ ID NO: 17118 - protein, 512 aa, Zea mays
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPSLEFFRDATCLD

SEQ ID NO: 17119 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQD

SEQ ID NO: 17120 - protein, 370 aa, Zea mays; identical to SEQ ID NO: 5711

SEQ ID NO: 17121 - protein, 110 aa, Zea mays; identical to SEQ ID NO: 14516

SEQ ID NO: 17122 - protein, 1184 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 17123 - protein, 393 aa, Zea mays
RLPNVAPLSKCRLRLLKLERVKDYLLMEEEFVAAQERLRPQEDKAEEDRSKVDDLRGTPMSVGSLEEIIDESHAIVSSSVGPEYYVSILSFVDKDQLEPGCSILMHNKVLSVVGILQDEVDPMVSVMKVEKAPLESYADIGGLDSQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 17124 - protein, 254 aa, Oryza sativa (japonica cultivar-group)
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFHRHHQLRHREVRL

SEQ ID NO: 17125 - protein, 338 aa, Burkholderia fungorum
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 17126 - protein, 143 aa, Glycine max
MASDGFTDKNTVFRKLKAKSENKMCFDCNAKNPTWASVTYGIFLCIDCSAVHRSLGVHISFVRSTNLDSWSPEQLKTMSFGGNNRAHGFFKQHGWTDGGKIEAKYTSRAADLYRQILSKEVAKSMAEDGGLPSSPVASQSAQG

SEQ ID NO: 17127 - protein, 467 aa, Micromonospora echinospora
MTRPADPSAERRTMVPSKFIFGLSPVGSAALRAAPPSRRPPLAPGGSGLGVRAVVIGSVATASLAAGLAAAAGTALRHGRPAGRRRFAREVARTVARLGPTFIKAAQVLGTRRDVVPALLCDELSMLQDDVPPMDAAQSRAALREVYGDRLDTVFASVEETPVASGSIACVYRATLPDGATVAVKLRRPGIGPQMAADLGLLRRGASVVARLPMFRGVPVREVVDSLCESVLGQLDLGREGRDLDRLREDLGGVPRVRVPRVHAAASRPAAIVMDFIPDLAVDTGARCPRAMRRTFAASTLTVVYQMLFINGFVHCDLHPGNLYFTRSGQVVVLDAGFSVQLSDKMRGLFADFFLNMSIGRGDRCAAIVLESAIGVADDADVPAFTEGVKDLVARSYRLSAKEFSLIAFAGELFDLQRRYGVAASPELVFPLLSLLVVEGTVRSLDPDIDFQETAKPVLNRALFGIR

SEQ ID NO: 17128 - protein, 158 aa, Oryza sativa
HEGQVAARRRGRHRRRDQPQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRL

SEQ ID NO: 17129 - protein, 254 aa, Oryza sativa
SLDFQRIDGDNDRSENDGDSWTDQETLLLLEGIEKYNDNWNNIAEHVGTKSKAQCIYHFIRLPVEDGLLENIEVPDASVPFRAETNGYPHLDCNGSTSGNLPQKIPPDNQLPFINSSNPVMSLVGFLASAMGPRVAASCASAALSVLTVDDDSRVNSEGICSDSRGQGPHPNFRDHNGGVSSSISPEKVKHAAMCGLSAAATKAKLFADQEEREIQRLTATVINHQVSVNVAILFTFGPCFSHYCCHQGVKNRR

SEQ ID NO: 17130 - protein, 459 aa, Xanthomonas campestris pv. campestris str. ATCC 33913
MTDTPGRSDAATLERFGYAQELKRQLSLKDLLIYGLVFMVPTAPFSIFGGVFDISAGMVPLTYLVGFVAMLFTALSYQQMSQAFPVAGSVYAYVGRGLSGGMGFLAGWAILLDYLLVPTLIYVVGANAMHNVLPQVPQPAWIAFFVVLNTVVNLRGIETTARANRFFLYAQLIVLALFVVLATLAIQRGVNGAQWTLRPFYNPQAFSPQLIFSALSVAVVSFLGFDAISTLSEEARGGNRVVGRATLLALVLVAGLFVLQTWLAALLQPHLQRYPSAQASNDAFFEIGRLIAGPWMQIVIALTVAISAAIANSLVAQAATSRLLFAMARDRQLPAFLRYIHPRTGVPQRAILLVAALSMVLGEVFVGQIALLSSLCNVGALTAFVLLHVAVLWHFRAHGRKVLHGVVPVIGIVILAYVLINADLHAQLGGSAWMVVGLAVLAFLKFSGRSTEFRATDAL

SEQ ID NO: 17131 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 17132 - protein, 427 aa, Batrachospermum theaquum
IEASAAVAGESSTATWTVVWTDLLTACDLYRAKAYKVDAVPNTSDQYFAYIAYDIDLFEEGSIANLTASIIGNVFGFKAVKALRLEDMRIPIAYLKTFQGPATGTIVERERMDKFGRPFLGATVKPKLGLSGKNYGRVVYEGLKGGLDFLKDDENINSQPFMRWRERYLFAIEGVNRAQAAAGEIKGHYLNVTAATMEDMYERAAFAKELGSIICMIDLVIGYTAIQTMAIWARKSDMILHLHRAGNSTYSRQKNHGMNFRVICKWMRMAGVDHIHAGTVVGKLEGDPLMIKGFYDTLLLSHLDINLPNGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 17133 - protein, 219 aa, Oryza sativa (japonica cultivar-group)
FTDKDKAAAHLKGGAKKFVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGY

SEQ ID NO: 17134 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 17135 - protein, 355 aa, Kluyveromyces lactis
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 17136 - protein, 832 aa, Triticum aestivum; identical to SEQ ID NO: 10488

SEQ ID NO: 17137 - protein, 414 aa, Zea mays
  unsure (1)..(414): unsure at all Xaa locations
MAAMPGGAHGAGAADPMQVDQPLPPAAAGTAHAPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFXVPESLYRVLEHYSNMNQRMPFIYVKLYTYQIFRGLAYIHTVPGVCHRDVKPQNLXVDPLTHQVKICDFGSAKMLVKGEANISYICSRYYRAPELIFGATEYTTSIDIWSAGCVLAELLLGQXPLFPGESAVDQLVEIIKVLGTPTREEIRCMNPNYTEFRFPQIKAHPWHKIFHKRMPPEAIDLASRLLQYSPNLRCTALEACAHPFFDDLREPHARLPNGRPFPPLFNFKQELANASPELINRLIPXHARRHLGLTLLPATGP

SEQ ID NO: 17138 - protein, 461 aa, Bacillus subtilis subsp. subtilis str. 168
MSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 17139 - protein, 311 aa, Vibrio cholerae
MKVAVIGAAGGIGQALALLLKNRLPAGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRLPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEALLDIGKLSAYEQAALDGMLDTLKGDIQIGVEFVK

SEQ ID NO: 17140 - protein, 233 aa, Triticum aestivum
MAFHLRSISLPSRPQANQTEVEQEVLSLEASISSSTTTIGTMCAGLRRLRDIYNGVEEIIGLPSNQAGKMFDSEMEGSLELLDLCSTMQEIFVEMKAIIQELQVALRKGDDATAQAKIQSYARLVKTAKKHFKKSAKKANVVSAACKVVMLLTKAREVSVSLLESTVHLLSKEIRMPKQSLVSKAFHKKKAVVCQEEQLQELECSIGDLENGAGHLFRKLIQIRVSLLDILSS

SEQ ID NO: 17141 - protein, 334 aa, Xylella fastidiosa Ann-1
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 17142 - protein, 749 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 17143 - protein, 121 aa, Glycine max
AVNNCRYDSSLGLLTKKFVSLIQDAKDGTLDLNRTAEILEVQKRRIYDITNVLEGVGLIEKTSKNHIQWKGCDGLGPQELEDQVNSLKVLILFTCQLVQMFYIIYAFRLLYMVALNCEPHL

SEQ ID NO: 17144 - protein, 390 aa, Zea mays
MAAAALLRRIPAARAPATAFMAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 17145 - protein, 380 aa, GIBBERELLA ZEAE PH-1
MTAFPPPPVNTIDWSNVGFKVREVNGHVESTYSKITGKWTPLRFVADPFMRIHGMAPALNYGQQAYEGLKAFRTPNDEAITVFRPDRNAKRLQHSAEVVSMPPVPEDLFLSAVRAAVALNAEYVPPHDTGAALYIRPQLYGSSAQLGLSPPDEYIFAVFVIPTGVYHGAHPVKALILEDFDRAAPHGTGNAKVGGNYAPVLRWSDKARDEGYGITLHLDSVRHEEIDEFSTSGFIGVKVNGDDVTLSVPDSKNVIDSVTSDSIQELGRSYGWKVEKRAIKYGELKEFSEVFAAGTAAALVPIRSITRRVDGKEDIATYIKEGSEEPGPLFEKLLKHLKDIQLGRAEDSFSWRFPVGVKDKEIQGASTGGNGDATTVDQMD

SEQ ID NO: 17146 - protein, 488 aa, Streptomyces avermitilis MA-4680
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 17147 - protein, 521 aa, Oryza sativa
MEVNGGGAAGLPEAWSQVRAPVIVPLLRLAVAVCLTMSVLLFLERMYMAVVISGVKILRRRPDRRYRCDPIPDDDPELGTSAFPVVLIQIPMFNEREVYQLSIGAVCGLSWPSDRLVVQVLDDSTDPVIKEMVRIECERWAHKGVNITYQIRENRKGYKAGALKEGMKHGYVRECEYVAIFDADFQPDPDFLRRTIPFLVHNSDIALVQARWRFVNADECLMTRMQEMSLDYHFTVEQEVSSSVCAFFGFNGTAGVWRVSAVNEAGGWKDRTTVEDMDLAIRASLKGWKFVYLGDVQVKSELPSTFKAFRFQQHRWSCGPANLFRKMLMEIVRNKKVTIWKKIHVIYNFFLIRKIIAHIVTFAFYCLIIPATIFVPEVRIPKWGCVYIPTIITLLNSVGTPRSFHLLFFWILFENVMSLHRTKATLIGLLEAGRANEWVVTEKLGNALKMKSSSKSSAKKSFMRVWDRLNVTELGVAAFLFSCGWYDLAFGKDHFFIYLFFQGAAFFIVGIGYVGTIVPQS

SEQ ID NO: 17148 - protein, 313 aa, Streptomyces avermitilis MA-4680
MVIMSASWSSHAFQPVLERIADEIERTPGRGRPADYIPALAACDPRRFGMAVAELDGTVYGVGDWRQPFSTQSITKVFTLALDLAREGDALWEHVGREPSGNPFNSLVQLEYESGIPRNPFINAGALVVTDRLQTQTGDAAGSLLEFLRAESGNPRLTFDQDVAASEAAHGDRNAALGHFMASYGNIDNSVPVLLDQYFRQCSIEASCADLALATGFLARHGIRADGSRLLTQSQAKQVNAVMLTCGTYDAAGDFAYRVGLPGKSGVGGGIIAVVPGRCTLCVWSPGLDERGNSVAGVAALDRFTTLTGVSVF

SEQ ID NO: 17149 - protein, 342 aa, Corynebacterium efficiens
MIRADLTDIPTYVPGKNLGDALKLSSNEVAFPPLPAAVSAITEAATGANRYPDMGAVELRGVLADHLELTPEQITVGCGSSALCQQLVQATCAAGDEVIFPWRSFEAYPIFARVAGATAVPIPLLPDTQGHDLEGMLDAITDRTRLIFLCNPNNPSGTTFTEEQFEAFMQRVPADVVVGLDEAYFEFNRAEDSPVSTEAVQRYPNVIGLRTFSKAYGLAGVRVGYAFGNPELIGAMNKVAIPFAVSSLAQAAAIASLNAADELLERTEEVVTERERVAQVVGAAPSQANFVWLPGEGAAELAGRLAEHGVVIRAFPEGARITVTNAAETDRLIRAWEAVHHG

SEQ ID NO: 17150 - protein, 196 aa, Zea mays
MDLSAVQAALSDKSYSTLASLCDELLLQAASQGFTTDEWPYSVHLLAHLYINDLNSARFFWKSLPQEVKDTRPELAAVWRIGQCLWKRDYAGVNTAAQGFEWGPDLADFITAFLESYRQRIFKLLTSAYSTIRVADVAHFMGMSEEDATNYAAQNGWSLDAAAKMLTVKKPKSQTNQKLDASKLQRLTECVFHLEN

SEQ ID NO: 17151 - protein, 281 aa, Glycine max
CTAGASQQVSVPAVIRSSADWQGKKTRKKKHKRSSSSSKNKTFHGGVLEGSNPECVDFQDVWCGPGIGFSTDAAAAASVDCVVARKNVSSARGKIDVDKITHRERSSYVGRRTETFTFLDSTDPDIFTPRSASDSYGTATYYRHVRDPSSDGFAEIMMLQGSLLMGGQLNSHDHFKDWRLDVDNMSYEQLLELGERIGHVNTGLKEDEMGRNIRKTRLQFWDDTSKHQVDKECSICQEEYEAGNELGRLNCEHSYHFQCIKQWAAQKNFCPVCKQQVAARH

SEQ ID NO: 17152 - protein, 115 aa, Cicer arietinum
MSGATPNPTPNPEEDKKPNDAAHINLKVKGQDGNEVFFRIKRNTQLKKLMNAYCDRQSVDLNSIAFLFDGRRLRAEQTPDELDMEDGDEIDAMLHQTAEPVKLGCCSGSCENFNT

SEQ ID NO: 17153 - protein, 754 aa, Novosphingobium aromaticivorans
MSEESNVRFTEREALFYHNTIRPGKIEIIASKPMATQRDLSLAYSPGVAVPVRAIAEDPSTAYDYTAKGNLVAVISNGTAILGLGNLGALASKPVMEGKAVLFKRFADVDSMDIELATEDADAFIEAVALLEPTFGGINLEDIKAPECFIIEQALKERLKIPVMHDDQHGTAIISAAGLLNACHLTGRRLEDVKVVVNGAGAAAIACTALIKAMGVRHDNVIMCDRSGVIYRGRESGMDQWKSAHAVDTTARSLEDALVGADIFLGLSAAGALKPEWVLKMAPQPIIFAMANPDPEITPPDAKAVRPDCIVATGRSDYPNQVNNVLGFPFIFRGALDVRATAINEEMKIAAAEAIAQLAREPVPEEVAAAYGMNHTFGLDYIIPAPFDPRLMEVVSSAVAKAAMDSGVAQKPIEDFDAYRTSLKARLNPTTSVLTNVFATAKDNPKRVVFAEAENEVVLRAAIQFKDFGYGTPVLVGRTQPVLDLLTELGVSDPSSYEIHNSAVSPLVPEMVEYLYERLKRRGYLERDVRRMVNQDRNVFASLLVALGHGDALITGMTRTFAQSMKEVRRVLDPKPGHLPFGIHLMVAKNYTVFLADTTVNERPSAEDLAHIARETAAVARRMGHEPRVAFLSYSTFGNPYGRWLDSIRGAVAILDAENPGFEYEGEMAPDAALNPKVMANYPFSRLSGPANVLIMPGLQSANISAKLLRELAGNAVIGPMLLGMEKPVQIAPMTSIAPDILTLAVLAAAGIVG

SEQ ID NO: 17154 - protein, 375 aa, Candida boidinii
MLSQTFLRRTPIIRKSPISLALRLQSTFQIPEKQMAVIFETNGGPLEYKEIPVPKPKPTEILINVKYSGVCHTDLHAWKGDWPLATKLPLVGGHEGAGVVVAKGESVTNFEIGDYAGIKWLNGSCMSCEYCEQGHESNCPDADLSGYTHDGSFQQYATADAIQAAKIPKEADLAEVAPILCAGVTVYKALKTANLQAGQWVAISGAGGGLGSLAVQYAKAMGYRVVGIDGGADKGELVKSLGGEVFIDFTKEKDLTKAIQDATNGGPHGVINVSVSEAAISQSCDYVRSTGKVVLVGLPAGAVCHSPVFQHVVKSIEIKGSYVGNRADTREAIDFFSRGLVRSPIKVVGLSELGDVYEKMEKGAILGRYVVDTSY

SEQ ID NO: 17155 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 17156 - protein, 541 aa, Oryza sativa (japonica cultivar-group)
MGRQDQQLQVLNALDAAKTQWYHFTAIIVAGMGFFTDAYDLFCISLVTKLLGRIYYTDPASPTPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 17157 - protein, 359 aa, Salmonella typhimurium
MSTENTLSVADLARENVRNLVPYQSARRLGGNGDVWLNANEFPTAVEFQLTQQTLNRYPECQPKAVIENYAQYAGVKPEQVLVSRGADEGIELVIRAFCEPGKDAILYCPPTYGMYSVSAETIGVERRTVPALENWQLDLQGISDNLTAQKWCSFVAPIILPDNLINPQDLRTLLELTRGKAIVVADEAYIEFCPQATLTGWLVEYPHLVILRTLSKAFALAGLRCGFTLANEEVINLLLKVIAPYPLSTPVADIAAQALCPQGINAMRDRVAQTVQERQYLVNALQQTACVEHVFDSETNYILARFTASSSVFKSLWDQGIILRDQNKQPSLSGCLRITVGTRQENQRVIDALRAEPV

SEQ ID NO: 17158 - protein, 365 aa, Zea mays
MGSIMEQRCNNDPQALLDAQLELWHSTFAFIKSMAFKSALELGIADAIHCHGGTATLTQIATKAALHPSKTPCLRRLMRALTVAGIFSVAKNSSDDDSDQHVYGLTPASRLLVGSSQNLAPTLSLILNNVFVAPFLDLGTWFESALAATDLPLFELSHRKNVWDVVGHDPSVSQLFNAGMVADTRFLMDIAVRECGDVFQGIRSLVDVGGGHGAAAQAISAAFPAIQCTVLDLAHVVATAPACAGLSFVAGDMFEAIPPANAVFLKWIMHDWGDTECVTILKNCKKAIPPRDAGGKVIIVDTVVGAGPPNLKNKETQVMSDLFFMIVNGLERDEQEWRNIIFEAGFSDYIIIPVLGVRSIIELYP

SEQ ID NO: 17159 - protein, 556 aa, Mycobacterium tuberculosis CDC1551
MPDDIAAADPTDTQPHLRRDLANRHIQLIAIGGAIGTGLFMGSGRTISLAGPAVMVVYGIIGFFVFFVLRAMGELLLSNLNYKSFVDFAADLLGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 17160 - protein, 458 aa, Chondracanthus exasperatus
  unsure (1)..(458): unsure at all Xaa locations
PDYVVKETDVLALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAAAGETKGHYLNVXXXXXXXXXXXXXXXXXLGSIIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFRGGTIGHPDGIQASATTNRVSLESMVIARNEGRDYVSEGHQILQDAAKTCGTLQTALDLWKEIAFNYTSTDTADFVKTPPANV

SEQ ID NO: 17161 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 17162 - protein, 261 aa, Oryza sativa (japonica cultivar-group)
MSTAVARGGMMPAGHGFGKGKAAAVEEEEDEVNGFFVEEEEEEEEEEEAAVSDASSIGAASSDSSSIGENSSSEKEGEEEGEEVESKAKEVAVEVEGGGLGFHGLGTLESLEDALPIKRGLSNFYAGKSKSFTSLAEAAAKAAAKEIAKPENPFNKRRRVLAAWSRRRASCSSLATTYLPPLLAPDHAVVEEEDEEDDSDAEQCSGSGGGNRRREPTFPPPRLSLHAQKSSLTPRSSNPASSFRSPRSFSLSDLQNAGSYN

SEQ ID NO: 17163 - protein, 668 aa, Eremothecium gossypii
MLRRVTVRQLANVRALARATRPLAVARAFSGAAGRLGAEAQEAPRRRAPGPRGETEPQGAAGAHEMDHSMIGFSGGEIFHEMMRRHNVDTVFGYPGGAILPVYDAIYNSDAFNFVLPKHEQGAGHMAEGYARASGKPGVVLVTSGPGATNVVTPMADALADGVPMVVFTGQVPKAAIGTDAFQEADVVGISRSCTKWNVMVNHVEELPRRINEAFEIATSGRPGPVLVDLPKDVTAAILRSPIPLASALPSTTLAQLTRQAADIDGVRSLADASRLINMAQKPVLYVGAGILNSTRGPEFLRELAEKAQIPVTTTLQALGAFDQEDSKSVDMLGMHGSAAANLTVQNADLIIALGARFDDRVTGNIAKFAPEAQRAAREQRGGIVHFEISPKNINKVVDAQVAVEGDVTANLEKLLPLIKPVAERKEWLGQIASWKSEYPYDYSRETPGSRIKPQTVITRLSEIANATGKEVIVTTGVGQHQMWAAQHWTWKKPRTFITSGGLGTMGFGLPAAIGAQVAKPDAIVIDIDGDASLNMTLMEMSSAVQAGAPVKILLLNNEEQGMVTQWQSLFYEHRYSHTHQLNPDFVKLADAMGFKAMRLEAQSDMEPMLQEFINCKEPVLLEVAVEKKVPVLPMVPAGKALHEFIYFDPEVERQQAELRSRRTGGKH

SEQ ID NO: 17164 - protein, 344 aa, Mycobacterium tuberculosis H37Rv [sequence omitted]

SEQ ID NO: 17165 - protein, 143 aa, Glycine max
  unsure (1)..(143): unsure at all Xaa locations
MASSMISSPAVTTVNRAGAGMVAPFTGLKSMAGFPTRKTNNDITSIASNSGRVQCMHVWPPVDKKKFETLSYLPYLDNTQLAKEXEYLLKKEXIPYLEFECKHDFIYHKHNRSPGYYNKHYXTIVKLAIYNYTNTSQILRDLQ

SEQ ID NO: 17166 - protein, 172 aa, Staphylococcus epidermidis ATCC 12228
MDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 17167 - protein, 339 aa, Arabidopsis thaliana
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSFSSSSPCKRRKLSGYSWVGDETSTSN

SEQ ID NO: 17168 - protein, 510 aa, Caulobacter crescentus CB15
MKLTFKPLAGLMLAATIAGAPLGATAFAQEAAPAPVAAAPAEAAPAPAAAPAEAAPAPAAAPTIEDKMDKGDNAWMLTSALLVLLMILPGLALFYGGLVRAKNMLSVMMQVSTVALIGFVAWMLWGYSFAFTDGGSWDKFVGGLGRVFLNGVTPASNVATFSTGVVIPELTFIAFQSTFAAITAALVVGSLVERMKFAAIVAFAILWPLLSYYPIAHMVWWWPGPNAIALAPEDTVKSGLLWGFGALDFAGGTVVHINAGIAALVGALILGKRQGYGKEPMPPHSLTLTLVGAGLLWVGWFGFNAGSNLESNGYASLAMVNTFIATAGAGLSWILVEWVTRKKPSALGLASGIVAGLVAVTPAAGFAGPMGALILGLVVSPICIIFCSVVKNALKYDDSLDAFGIHGIGGIVGAIGTGLVVNPAWGGAGVVDYTSCGKDGDLSTCDTAVYDMGVQLMAQLKAVGVTILWSAIATAIVFFIIKLVIGLRAAPEAEEDGLDISEHGERAYHS

SEQ ID NO: 17169 - protein, 469 aa, Shewanella benthica
MSAESVLQQLKELEVKFVDLRFTDTRGKEQHVSIPSHQVDEDFFEDGKMFDGSSINGWKGINESDMVLMPDPESFVLDPFTADTTAIIRCDILNPGTMTGYNRDPRSIAKKAEEYLRSTGIADTVLLGPEPEFFLFDDVKYGSDMSGCFYKLDAEEASWNSGTSYEGGNTGHRPSVKGGYFPVPPVDSSQDIRSAMCLILEEMGQVVEAHHHEVATAGQNEIATRFNTLTLKADEVQVLKYVVHNVAHVYGKTATFMPKPIVGDNGSGMHVHISLAKDGTNLFAGDKYGGLSELAIYFIGGVIKHARAINAFSNPATNSYKRLIPHFEAPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSSDFIDSYITLKTEDVERVNQTTHPVEFELYYSL

SEQ ID NO: 17170 - protein, 535 aa, Hordeum vulgare subsp. vulgare
MAREQLEVLSALDTAKTQWYHFTAIVIAGMGFFTDAYDLFCISLVTKLLGRIYYYREGADAPGSLPPNVAAAVNGVAFCGTLSGQLFFGWLGDRMGRKRVYGMTLMCMVLCSIASGLSFGSTPGSVMATLCFFRFWLGFGIGGDYPLSATIMSEYANKKTRGAFIAAVFAMQGFGILTGGVVTLIVSAAFRAAFHAPAYEKGAVASTPPQADFVWRFILMFGAVPALLTYYWRMKMPETARYTALVAKNAKQAAADMSKVLQVEIAAEDETKDNDGAGEDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYALTFFFANFGPNSTTFIVPAEIFPARLRSTCHGISAAAGKLGAIVGSFGFLYLAQNQDPSKVDHGYKAGIGVKNSLFILAACNFLGMAFTFCAPESNGISLEELSGENDDEAPAPATHARTVPV

SEQ ID NO: 17171 - protein, 123 aa, Oryza sativa
IMFQDITTMLLKPDAFRDTIELFVERYKDKGITVIAGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 17172 - protein, 561 aa, Leuconostoc mesenteroides subsp. cremoris
MKNVVLTEWKNGAHILLDSLEKAGVNSLFGCPGGAVIPLYDALYESSHIKHILVRHEQAAAHAAEGYAKATGKPGVVLVTSGPGATNTVTGIADAFCDSVPLVVISGQVGSAAIGSDAFQELDILSITSSITKMSYQVRTVGELPLIVEEAFKVAVSGRPGPVLIDLPKSVMLAKDTEESQADIWLRQIDTQKPDVDAVQIHQLVAALSKARQPLIITGAGVLKSNAQDLLRTLIQHYHIPTVSTLLGLGAVESENPLFLGMVGMHGSIAANQAVDQADFVLNIGSRFDDRVVTNVDDFAKHATIAHIDIDETELGKVLPTAHAIHASADDALNAILTEIKNAKMTDTSKWQESICQAKRDSMFHYQKSETAIMPQVVIQAVGKVTKGEAVVVTDVGQHQMWVAQYYPFQNNYQMLTSGGLGTMGYGIPAAIGAKFARWDKEVVLFVGDGGFQMTSEELAILNDNDLNIKIILLNNHSLGMVRQWQTLFYNGRLSSTVFKSQPQFNQLAQAYGINYVRIEKPERILEDLQLAFQSDKSVLIEIIIPDDVKVLPMVNAGRLS

SEQ ID NO: 17173 - protein, 572 aa, Oryza sativa (japonica cultivar-group); identical to SEQ ID NO: 582

SEQ ID NO: 17174 - protein, 554 aa, Bdellovibrio bacteriovorus
  unsure (1)..(554): unsure at all Xaa locations
MQHLPAMIHDLALILGTAGLVTLLFKKLNQPIVLGYLVAGFLVGPKISIFPTVIGVASINLWAEIGVIFLLFALGLEFSFKKLLRVGGSASFTALFEVSLMILFGFTTGRLLGWSTMDSLFLGGILSISSTSIIIRTVEELGMKNMKFVGMVFGVLVIEDLVAVLLMVLLTTVALTRDFSGTEMLGAVLKLSFFLSIWFVAGIFLLPSFLKRTQKLLSEETVLVVAVGLCLMMVVFASNVGFSSALGAFITGSILAETIEGERIHHLIAPIKNLFSAVFFISVGMLIDPQVISIYWKEVLLLSAVVVVGKTLSVTLGSVLSGQTFKSSLQSGMSLAQIGEFSFIIATLGLSLKVISEKIYPIAVAVSVLTAFTTPYMARSAEKTYAWLEKILPARFIQSIDSYSVLSFSMSGNREWREQVRAYVLKVLLNAVVVVAVFLTMARVFLPFLLERQMEEGPAKFLTLSATLVMSAPFLWALAFGRTKQFEALLVEQGKGSHNYVFLVSRIMLAVGLLGAMVGQFVPLMWAVAITLWMVVVVGYVLSQXXLFXHXRVT

SEQ ID NO: 17175 - protein, 213 aa, Cardamine flexuosa
MVRGKTQMKRIENATSRQVTFSKRRNGLLKKAFELSVLCDAEVSLIIFSPKGKLYEFASSNMQDTIDRYLRHTKDRVSSKPVSEENMQYLKFEAANMMKKIEQLEASKRKLLGEGIGTCSIEELQQIEQQLEKSVKCIRARKTQVFKEQIEQLKQKEKALAAENGKLSEKWGSHETEVWSNKNQESGRGDEESSPSSEVETQLFIGLPCSSRK

SEQ ID NO: 17176 - protein, 424 aa, Glycine max; identical to SEQ ID NO: 9034

SEQ ID NO: 17177 - protein, 337 aa, Zea mays; identical to SEQ ID NO: 2954

SEQ ID NO: 17178 - protein, 512 aa, Glycine max
  unsure (1)..(512): unsure at all Xaa locations
EVRREKWQSPLPSRQLFTKMESGKFPLLNKXRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGXTAILKPSELASVDCLELSEICXEVGLPPRVLNIVTGLGXHEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWXKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 17179 - protein, 164 aa, Zea mays; identical to SEQ ID NO: 4781

SEQ ID NO: 17180 - protein, 391 aa, Zea mays
  unsure (1)..(391): unsure at all Xaa locations
MELEATMICIHNSEWMRNGDYAPSRFQAQADAVNLICGAKTQSNPENTVGVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHIPPGENALSDVLLSTPIFTGEEGGSGFAASAAAAAATGASGFEFGVDPNVDPELALALXRLSMEEERARQEAIAKKAAEDTSNTEHNNVPSSNSDSVMAEGEPASNAAAGDKEQPKDDDDLLQQALAMSMEGXASGSAAVTDSAMAEAGAVDPDLALALQMSVQDANMSSDTDMSKVFEDRTFVSSILNSLPGVDPNDPSVKDLLASLHSQGEQEKKEDTSDKTEDDKN

SEQ ID NO: 17181 - protein, 160 aa, Glycine max
  unsure (1)..(160): unsure at all Xaa locations
LLSDADKLREIGGDQDKHLKDNFKLIDTTNMWVSLRAIKRFVDTVEVRQKKPSFSKDTAAGPAIKFFDNVFGVSVPESRFLPLDATSDLLLLQSDLYTCREGVLTRNPARTNPLNPVIDLGPEFEKFGDFQSRFRSIPSIIELDSLMVRGDVWVXANITL

SEQ ID NO: 17182 - protein, 427 aa, Batrachospermum kraftii
  unsure (1)..(427): unsure at all Xaa locations
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAGTMEQMYERAAFAKELGSIICMVDLVIGYTAIQSMAIWARKTDMILHLHSAGNSTYSRQKIHGMNFRVICKWLXMAGVDHIHAGTVVGKLEGDPLMIKGLYDTLLLSHLDINLPHGIFFEQNWASLRKVTPVASGGIHCGQMHQLLDYLGDDVVLQFGGGTIGHPDGIQAGATANRVALESIVMARNEGRDYVAEGPQILRDAAKTCGPLQTALDLWKDISFNYTSTDTADFV

SEQ ID NO: 17183 - protein, 353 aa, Fragaria x ananassa
VEVLAATQTPGESGKKWFQGTADAVRQFHWLFEDARSKDIEDVLILSGDHLYRMDYMDYIQNHRQSGADITISCLPMDDSRASDFGLMKIDKKGKVLSFSEKPKGNDLKAMAVDTTVLGLSVEEALKKPYIASMGVYVFKKEILLNLLRWRFPTANDFGSEIIPASANEFFMKAYLFNDYWEDIGTIRSFFEANLALTEHPNKFSFYDAAKPMYTSRRNLPPSKIDGSKIVDSIISHGSFLTDCLIEHSVVGIRSRINTNVHLKDTVMLGADYYETDSEVLSLLAEGRVPVGIGENTKIKDCIIDKNARIGNNVVIANTEGVQEADRSSEGFYIRSGVTVILKNSTIEDGLSI

SEQ ID NO: 17184 - protein, 298 aa, Triticum aestivum
  unsure (1)..(298): unsure at all Xaa locations
MRAMASGGGNWLGFSLSPHMAMEVPSSEPDHAQAQPASASAMSASPTNAATCNLLFSQPAQMAAPPPGYYYVGGAYGDGTSTAGVYYSHHSVMPITSDGSLCIMEGMMPSSSPKLEDFLGGGNGSGHDAVTYYSHHQQQQDQQDQEASRIYQHHQQQLAPYNFQXLDTFGQRTSQYRGVTSRHRWTGRYEAHLWDNSCKKDGQTRKGRQVYLGGYDNEDKAARAYDLAALKYWGPSTNTNFPLENYREEVEEMKSMTRQEFVAHLRRRSSGFSRGASIYRGVTRHHQHGRWQARIGRV

SEQ ID NO: 17185 - protein, 593 aa, Yersinia pestis KIM
MEMNSRYPMSKLSPEAKPMEMLSGAEMVVRSLIDQGVKHVFGYPGGAVLDIYDALHTVGGIDHVLVRHEQGAVHMADGYARATGEVGVVLVTSGPGATNAITGIATAYMDSVPMVVLSGQVPSSLIGFDAFQECDMVGISRPVVKHSFLVKRTEDIPMVLKKAFYLASTGRPGPVVIDLPKDIVGPAVKMPYAYPEQVSLRSYNPTVQGHRGQIKRALQTIMAAKRPIMYVGGGAINAACHEELLILAEKLNLPVTSSLMGLGSFPGTHRQSVGMLGMHGTFEANMAMHNTDLIFAVGVRFDDRTTNNLAKYCPDATVLHIDIDPTSISKTVTADIPIVGDAKQVLTQMLDLLSQVGCTQDFDSLRDWWQSIEQWRTRNCLGYNKDSGKIKPQAVIEALHRLTKGDAYVTSDVGQHQMFAALYYPFDKPRRWINSGGLGTMGFGLPAALGVKLALPNETVVCVTGDGSIQMNIQELSTALQYNLPVLVLNLNNRYLGMVKQWQDMIYSGRHSQSYMDSLPDFVKLAEAYGHIGVAINTPDELESKLADALTQLSETNRLVFVDVTVDETEHVYPMQIRGGGMDEMWLSKTERT

SEQ ID NO: 17186 - protein, 380 aa, Triticum aestivum; identical to SEQ ID NO: 2542

SEQ ID NO: 17187 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 17188 - protein, 336 aa, Oryza sativa (japonica cultivar-group); identical to SEQ ID NO: 2130

SEQ ID NO: 17189 - protein, 307 aa, Arabidopsis thaliana
MAKKPKQLRNKPRKSFSTQTFTVVVLVLFVILILVGLGIFSLPSTNKTSSMPMDLTTIVQTIQERESFGDEEDGNGDRWLEVISWEPRAFVYHNFLTNEECEHLISLAKPSMMKSKVVDVKTGKSIDSRFCTLTSVVVFTFQLNLERFENSKFANPSLCRVRTSSGTFLNRGHDEIVEEIENRISDFTFIPPENGEGLQVLHYEVGQRYEPHHDYFFDEFNVRKGGQRIATVLMYLSDVDEGGETVFPAAKGNVSDVPWWDELSQCGKEGLSVLPKKRDALLFWSMKPDASLDPSSLHGLYDLTNMY

SEQ ID NO: 17190 - protein, 256 aa, Pantoea toletana
GAAGGIGQALALLLKTQLPAGSELSLYDIAPVTPGVAVDLSHIPTAVKIKGFSGEDATPALKGADVVLISAGVARKPGMDRSDLFNVNAGIVRNLIEQVASTSPKALIGIITNPVNTTRAIAADVLKKAGVYDKNKLFGVTTLDIIRANTFVAELKGKQPEDLNVPVVGGHSGVTILPLLSQIPGVSFSEQEVADLTKRIQNAGTEVVEAKAGGGSATLSMGQAAARFGLSLVRALKGESNVVECAYVEGDGQYAR

SEQ ID NO: 17191 - protein, 298 aa, Triticum aestivum
FPGYVIHLSSGIAGFTAAYWVGPRLKSDRERFSPNNILLMIAGGGLLGMGWAGFNGGAPYAANITASVAVLNTNVSAATSLLTWTCLDVIFFGKPSVIGAVQGMMTGLVCITPGAGLVQTWAAVVMGIFAGSVPWFTMMILHKKSALLMKVDDTLAVFHTHAVAGLLGGILTGLLATPELMTMESSVPGPKGAFYGGGIKQVGKQLAGAAFVIVWNLVVTTLILLGIGLFVPLRMPDDQLMIGDDAAHGEEAYALWGDGEKFDATRHDVSRGAGGEREMGTAEQRLAGMGARGVTIQL

SEQ ID NO: 17192 - protein, 276 aa, Cladonia arbuscula
  unsure (1)..(276): unsure at all Xaa locations
HGAVKVVAVNDPFVEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFXAKAG

SEQ ID NO: 17193 - protein, 334 aa, Microbulbifer degradans 2-40
MIKAYAAMEPGAALVPFEYEPGPLANNEVELKVESCGICHSDLSMLDNEWGFTQYPFVGGHEVIGIVEAVGSSVNNVAVGQRVGLGWHSGYCNTCASCQSGDQNLCNSAQPTIAGHHGGFADKVRADANAVVALPEGVNPDSAGPLFCGGITVFNPLVQFGIKPTSKVGVIGIGGLGHIALQFLNAWGCEVTAFTSSESKKEEALKLGAHHVLNSSDAAQLEAAAGRFDFIISTVNVKLDWNEYLATLAPKGRLHFVGATLAPLDINVFQLIGSQREISGSPVGSPGTISQMLDFAALHNIQPVTEYFRFDQINEALTKLREGKAHYRIVLTNK

SEQ ID NO: 17194 - protein, 247 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKEKALAEKQKDQRQQVQRDQTQQQTSSSSTSFMLREAAPTTNVSIFPVAAGGRVVEGAAAQPQARVGLPPWMLSHLSC

SEQ ID NO: 17195 - protein, 667 aa, Schizosaccharomyces pombe
MKDDQLIDWIHERYEEQKSANRLAGRFRFLGLETKYSIISIISGIFIGLTAALLNALASLLNSFREGYCTVNILFDKQTCCSTLTEDYECQEFFFWRNNHSVFVSCLIYVSVSVGFAFIATTLGYVVAPAARASGIPTIKAILSGYKYPDMNVFFSIKTLCSKSLAVCFSVASGLWVGKEGPFVHIATNIIYLVERIAPSLADSEIFTRQLLAAAMASGIAASFNAPVGGVIFALEQLASSSFPSLFTGSIWYEFLCSASSVVALQLIRSWHTDVGYLSYVSLDRRWSYKDTLPFIFISILCGCLGSVLIYLNMKFASKTKGFSKISNVFFVIFLSLITSLTAYAILGESELLFNPMELFPQVINSCSPSSSTVLCETTFWVTAIVLFTSALLGLLLTSATFGAAIPTGIIVPSLAIGACIGRAVGTLLKSRFPSLAGTSIYGVIGSIAFLSSTTRLVVALVVILFELTGALNIALPLMLATLISKWVSDSIIETSIYDAWIQFRNIPYFPSSNSLKFSIPLNFPVRSPEQLVRLPIRSCSIEELERAMHDSSQSFFVVLKNDTEFFEGFISRNKVSELLNRRPMSSNMQTTDNTGLDPLRSASAPVDSTFDLFDYIHPTTFTLNYDTPPVLMLKLFKDAGITNLALLNHGKLHGVLTKIVCFICTI

SEQ ID NO: 17196 - protein, 511 aa, Alcaligenes faecalis
MGEEMKTESKKPDSARSELAMKYFQAEYGHFINGEWVGGSSSEKIAMINPANLEVLSYIQSGNAEDVNRAVEAATQAFPKWSRSTPSERQAALYEMARRLRARANDYAAMLSLDNGKPIMEALHIDIPATIGQFELFAGAAFGLHGQTIDATQGVAIIHREPLGVVAQIIPWNVPLVMMATKIAPALAAGNTIVLKPAESVCLAVMEFIREMADLLPPGVLNVITGYGPNVGEALVTHPNVRKVAFTGSRPTAQKLMQYASVNVIPQTLELGGKSANIICADADMDAAAESAAMSIVVNKGEICFAATRHFVHESVMDAFVEKVQNILRKIRVGDPMIPSTQMGPQASRMQFDKVLGYLDIGRNEGATTAMGGKRATVSGFEQGYFIEPTLFTDVRNKMRIAQEEIFGPVGVVIPWKDEAQVIREANDTEFGLAAGLWTKNITQAHRMAREIEAGTVWVNRYFNMIPNVPFGGYKQSGFGREFSLDVLSHYTQLKSVIVSLQEGPIGLFDH

SEQ ID NO: 17197 - protein, 231 aa, Lycopodium annotinum
MGRGKIEIKRIENATSRQVTFSKRRGGLLKKAHELSVLCDAQVALIIFSSTGKLFEYASPSMKEILDRYGKYPEGVQTGTVTDPNNDVMLQYLNREVIRMKQQIERTHQTQRHMMGEDLAILPLKDLQQLEEQLDIGLRRIRARKDQLLVEQLEELHRKERHWLEENEALRRKLAGGQALSGPVPSPLSIVNPLETREPPSLGTVSLPFSVQFNQQNMQDTPNLQTSLQLG

SEQ ID NO: 17198 - protein, 377 aa, Bacillus subtilis subsp. subtilis str. 168
MSLNSSPSYRRRAGKGLVLCVCRKAFGKWAGFSNGWVYWTSEMLITGSQLTAISLFTKHWFPQVPLWVFASIYAVLGLLIIFTGLAVFEKTENVLAVIKTAAIFMFIVIAILALCGILSGGNHGIHVPNKTSEFFPYGAMGLWTGLIYAFYAFGGIEVMGLMAVHLKKPEEASKSGKLMLATLAIIYIISIGLALLLVPLHTFTEQDSPFITSLKGYNLEIILDIFNGIFIIAGFSTLIASLFAVTTLLCTMADDGDAPKCFTLKEGKKICWPALGLTFAGLVLSIILSLVLPKNIYEHMTTAAGLMLLYTWLFILFSSKKLTDPEGMGKTQIYLAMVLIAAAVSGTLFEKSSRPGFFVSIGFLVIIAIVTMIYQKK

SEQ ID NO: 17199 - protein, 812 aa, Schizosaccharomyces pombe
MSSQKRADSSSSFDQAERRSLDENERKKKYFFNREGSGIDNFETDGMVFQASKAFDYYLLTTFKDRVNEIINEQNEENVIDQSRWSKLWRIWNVGYSWFILSIIGTTVGFAAYMLDIVTSWLSDIRRGYCTSHWYYNEKFCCWYSETMGMFKHDLYNDLTFQGSSCTAWKPWTYKFSLNYLIYTAFALLFVLCAAIMVRDVAPLAAGSGISEIKCIISGFLRDSFLSFRVMLVKCVGLPLAIASGLSVGKEGPSVHLATTIGHNISKIFKYAREGSIRYRDICVASAASGVAVAFGSPIGGVLFGIEVGKFIEILTNSFKEMSGGYDPKMIVYSFFCCLSAVGVLHMLNPFRTGQVVLFEVRYSGSWHFFELLFFCFLGIFGGLYGEFVMRLFFLIQKLRKKYLSRWGVLDAAFVTVITSLVSFLNPWLRLDMTLGMELLFQECKSSSSPELINLCDPSLRTKNTILLLIATFARTIFVTFSYGAKVPAGIFVPSMAVGASFGYMIGLIAEMIYQRFPNSVLFLACHGSESCITPGTYALLGAAASLSGIMHLTVTIVVIMFELTGALNFILPTVLVVALANSIGNMLGKTGIADRSIEINGLPLLEPEKSINSSNTINIPITEVMASNLITIPSIGFTWRKLLGMMEGYDFSGYPVVLDSRSNYLIGYLKKSSLKSSFEAAKLEPSFTFDQQLCFGKVDSVGDSKSSKFGESDRIDLSAYMDVNPISVLHTQSIANVAVLFEVLSPSVIFIEKDGNLVGLISKKDLLLASKYYQEDNDLVNPANRHRAVSTERINDSYENIELKPLKLNIE

SEQ ID NO: 17200 - protein, 625 aa, Wigglesworthia glossinidia endosymbiont of Glossina brevipalpis
MNMIKKNKKKSFLCTIFSTINVLHGLIAISPIYIIKESFVNNLGFKIDKLAIFGILSIIFWTLFFIIFLKYLILIVSINNSGEGGILTLMSITAKKINSKSTFVIVILGLISMCLFFGDIIIIPSISIISVIEEISIYYLSFEKFIFIISIAIFTFLFFIQKKIKNEFNNIFSFLISIWFILVGLIGLKGIYINPEILLAINPKYLINFFKHYKLNAFFVFGTLILLISISEILYINIGRFSKLEIRKSWLFFVFPMIMINCFGQGSIILLYPESISHPFFFLVPDWARFFTFTFAIIISIISSQNIISSIFYLTRQAVRLGYLPNIKIFYTSEVKSRRIYIPCINWIFYLSAVIQISIFKNLHNLILIYGIGSIITMSLTTFFSLLFFKKKFEKFKILKITFLLTILILEFFIFISNSYKIICGGWFPIVFGIIFFTIMITWKVETFNLLLHTHNNSNSIKLFIKNLRKNNLLKVNGTSVFMSSMDNTIPLSIIHNIKHNKVLHEKIIFLNIKTEDSPFIKKECRVEIEKLNNGFWGVKAYYGFKETPDIKEIFHFCNLLGISLNIMETSFFISHESLILGKRPWYLAIRAKLFIFLKRNSLGSTYQYSIPLDRVIALGIQVKI

SEQ ID NO: 17201 - protein, 368 aa, Zea mays
MGHDEAVGTQNSVKAPSPPKDQPAIYPCFDWSTVQAYYGPGVLPPAFFNPGIAPGHAPPPYVWGPQTMPPAAFGKSYAAIYPHAGGFLHPLMPLVVNPLSAEPAKSGNSKDNSLNKKLKEIDGSAVSSGNSEKTSGDHSLEGSSDGNNPKVSGTPKKRSLDDRTTSETCGVSAINDTPGESGRLPALSSVRIPDTTMKPCVSTGSDFKVSGATSTEWPAKDDKASKRERRKQSNRESARRSRLRKQAETEELARRVELLTAENTSLRSEISRLTESSQKLRMENSALMEKLADGTSDQAQEASAGHQTPTAPSSACVVKNFLWMMDGEGASRGGGGSGCSSRRRDHGAPMLRQLLSSGPLAADAVAAS

SEQ ID NO: 17202 - protein, 538 aa, Triticum aestivum; identical to SEQ ID NO: 1450

SEQ ID NO: 17203 - protein, 181 aa, Bacillus amyloliquefaciens
MCGAFIGDEPFAVLLGDDIMVSDTPALSQLIDVYNQHATETVGVQPVDPADVSKYGIIQTGRQGGHVYQVEDLIEKPAVEKAPSHIAVMGRYILTPAIFKTLKTIGRGAGNEIQLTDALREVCRTRSIYARELEGSRFDIGDKFGCFKAGTEIGLLREEMRPKLLAYLEEVLKRESEEIVR

SEQ ID NO: 17204 - protein, 750 aa, Lotus japonicus
PYIFSTNNFVGRQTWEYDPDAGTPEERAQVEEARQDFYNNRYKVKPCGDLLWRFQVLRENNFKQTIPSVKIEDGEEITYEKATTTLKRAAHHLAALQTSDGHWPAQIAGPLFFQPPLVFCMYITGHLNSVFPEEYRKEILRYIYVHQNEDGGWGLHIEGHSTMFCTALNYICMRMLGEGPDGGQDNACARARKWILDHGGVTHIPSWGKTWLSILGIFDWKGSNPMPPEFWILPSFLPMHPAKMWCYCRLVYMPMSYLYGKRFVGPITPLILQLREELFTQPYEKVNWKKARHQCAKEDIYYPHPLIQDLMWDSLYLFTEPLLTRWPFNKLVREKALEVTMKHIHYEDENSRYITIGCVEKVLCMLACWVEDPNGDAFKKHLARVPDYLWVSEDGMCMQSFGSQEWDAGFAVQALLATNLVDELGPTLAKGHDFIKKSQVRDNPSGDFKNMHRHISKGSWTFSDQDHGWQVSDCTAEGLKCCLLLSMLPPDIVGEKMEPECLFDSVNLLLSLQSKKGGLAAWEPAGAQEWLELLNPTEFFADIVVEHEYVECTGSAIGALVLFKKLYPGHRKKEIENFISEAVRFLEDTQTADGSWYGNWGVCFTYGSWFALGGLAAAGKTYANCAAIRKAVKFLLTTQRGDGGWGESYLSSPKKIYVPFEGNRSNVVHTAWALMGLIHSGQAERDPTPLHRAAKLLINSQLEEGDWPQQEITGVFMKNCMLHYPMYRDIYPMWALAEYRRRVPLPSTAV

SEQ ID NO: 17205 - protein, 609 aa, Corynebacterium efficiens YS-314
MLSVQPARQKGRRMSTSDLIVRRLRDWGVKRVYGYSGDGNNALLGAIRRAEDGPEFIAARHEEGAAFMAVGDARYSRGVGVVTSTQGPGAIHILNGLYDAKLDSVPVVALVAQQSRSVLGSDYQQEVDLHTLFADVATPFLETVTTPEQLPMVIDRAFRSALANSGPAVVILPHDIQQAPEPDLGQEHGEIISTAHWSTGRILPRDEDLDHAIRVLSEGRKVAILAGRGVQDAQTEVLALAERLGAGVTTALLGKPYIDETHRLAAGNMGHLGTHSANWVLQNCDTLLIIGSNSPWTEFYPAPGQARAVQIDVDPAQMGNRYPIEVGLVGQAAPTLQALLEKLPEDLLDGKRSEWEQQVEQAIHNSQEINRRRSQVPARPLNPDLVARAVNTRLWENTQLAIDVGSSVYHYVRHITVPRGANAHLCSTLASMGCGIPYGFAAKEVTPDRPVVVMAGDGAMTMLGINELITVADRWKQWEDPRFVIVVLANKDLSEVSWEQRETEGEPRFEASQRVPAFDFVAYAEQLGLRGIHLHDSDTIDQVLAEAFESDRPVVVEAHTDADIPLIPPYPHGRELVDSMREGIRAEGTSGEHALSLLDAYAAIEEEYS

SEQ ID NO: 17206 - protein, 234 aa, Magnetospirillum magnetotacticum
MNPDRDPAFARRLAAAARQEQFLTVMSHEAALAAFRAAVPHTALPEETVPLAQALGRVLARDVASPIDVPPFDRALVDGFALRAADTEGAGPASPRRLTLNREILACGVAPARAVDPGTATPIATGGVIPRGADAVVMVEQTEFDEETLGIAVAAPVRPGQFVGYAGADMALGETVLRKGMPITAREIGMLAACGLAEVAVVRRPRVAVLSTGDELRRAGTAAAAGRDSVVFAF

SEQ ID NO: 17207 - protein, 519 aa, Debaryomyces hansenii
MSELLDSIQPYLTKWYVVISALLVSFFIAHKISVARFKATHNCAASPEYYKVNWFSLPLLYRLIQVKREGRLLDFAQKIYDDVKALTFVIKIVGVPVIITRDPENMKAVLATQFNDFALGTRHAHFKPLLGDGIFTLDGNGWKQSRSMLRPQFSREQVAHVQALEPHLQRLAKHIRLADGETINIQDLFFKLTVDTATEFLFGQSVYSLKDAAINDPPTEDFDGRSSFANSFNTAQTYLGTRAYLQMFYFIVNNSDFRKCCKQVHDFTRFYVQKGLDMTPEELEKKSENGYVFLYELVKQTRDPKVLQDQLLNILLAGRDTTAGLLSFTFFELARHPRVFNKLKEEIYEAFGKGDDARVSEITFESLKKCEYLKWVMNEMLRLYPSVPVNFRVATKRTTLPRGGGPDGNSPIYVGKGTTVAYSVYSTHRMEEYYGKDADEFKPERWAESRKLGWAYVPFNGGPRICLGQQFALTEASYIVTRLLQMFDKLELHDDRPYPPAKSVHLTMCHQDGVYVSLS

SEQ ID NO: 17208 - protein, 255 aa, Triticum aestivum
RKRPSTDFLETIQKDVNPSMRAILIDWLVEVAEEYRLVPDTLYLTVNYIDRYLSGNEINRQRLQLLGVACMLIAAKYEEICAPQVEEFCYITDNTYFKDEVLDMEASVLNYLKFEMTAPTAKCFLRRFVRAAQVCDEDPPLHLEFLANYVAELSLLEYSLLAYPPSLVAASAIFLSKFILQPAKHPWNSTLAHYTQYKPSELCDCVKALHRLFSVGPGSNLPAIREKYSQHKYKFVGKKQCPTSVPAEFFRDAAC

SEQ ID NO: 17209 - protein, 763 aa, Glycine max
  unsure (1)..(763): unsure at all Xaa locations
MWRLKIGDGGKNPYIFSTNNFLGRETWEFDPETSTIEERTQVKAACENFYKNRFKTRACGDRLWRFQFLREKNFRQTITSVKIQDDEEITNEKTTNTLKRAIHYLSALQTSNGYWPAQFSGPLFPTALFVMCMYITGHLDSIFPEEYRKEILRYIYFHQNEDGGWGLNIDGHSTMFSTTLNYICMRILGEGPNGGHNNACAKARKWIHDHGSVTHIPSWGKFWLSVLGVVDRCGINPLPPEFWILPTFSPMHPAKMWCYCRLIYMPMSYLYGKKFVGSITPLVLNLREELFTQPYDEDSWQKARHKCAEEDLYYSHPWIQDLIWXDSLYLFVEPLLTRWPLNKLIREKALQVTMKHIHYENENSRYLDMACVEKSLCMLACWVEDPNGDAFNKHLARIPDYFWVSEDGMIVQPXGSQAWDIGFIAQALLATDLIEEFGPTLAKAHDFIKKSQLTDNLPGDFKSMYRHISKGSWTFSDQDQGWQVSDCTAETLNCCLLLSILPSEIVGEKMEPQRLYDSVNILLSLQSRKGGLAAWEPSGTQEWLEILNPTEFLGNIVVEHDYAECTGSAIQALVLFKKLYPRHREKEIKNSIANAVQFLEDTQTANGSWYGSWGVCYIYGTWFALRGLAAAGKTYTNCAAIRKGVKFLLSTQKEDGGWGESYLSCPKQIYVPLEGSRSTVVHTAWALLGLILAGQAERDTTSLHRAAKLLINSQLKEGDWPQQELTGVFNRTCMLHYPMYRNIYPMWALAEYRRLVPLPSTEV

SEQ ID NO: 17210 - protein, 189 aa, Mitthyridium sp. Brown 36
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSCDFITDSQSSIFDAKAGIAL

SEQ ID NO: 17211 - protein, 335 aa, Xanthomonas axonopodis pv. citri str. 306
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPEIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 17212 - protein, 565 aa, Schizosaccharomyces pombe
MPAGTKEQIECPLKGVTLLNSPRYNKDTAFTPEERQKFEISSRLPPIVETLQQQVDRCYDQYKAIGDEPLQKNLYLSQLSVTNQTLFYALISQHLIEMIPIIYTPTEGDAIKQFSDIYRYPEGCYLDIDHNDLSYIKQQLSEFGKSDSVEYIIITDSEGILGIGDQGVGGVLISVAKGHLMTLCAGLDPNRFLPIVLDVGTNNETHRKNHQYMGLRKDRVRGEQYDSFLDNVIKAIREVFPEAFIHFEDFGLANAKRILDHYRPDIACFNDDIQGTGAVALAAIIGALHVTKSPLTEQRIMIFGAGTAGVGIANQIVAGMVTDGLSLDKARGNLFMIDRCGLLLERHAKIATDGQKPFLKKDSDFKEVPSGDINLESAIALVKPTILLGCSGQPGKFTEKAIREMSKHVERPIIFPISNPTTLMEAKPDQIDKWSDGKALIATGSPLPPLNRNGKKYVISQCNNALLYPALGVACVLSRCKLLSDGMLKAASDALATVPRSLFAADEALLPDLNNAREISRHIVFAVLKQAVSEGMSTVDLPKDDAKLKEWIIEREWNPEYKPFV

SEQ ID NO: 17213 - protein, 286 aa, GIBBERELLA ZEAE PH-1
MPLVGGHEGAGVVVARGELVKDVEIGDHVGLKWLHGSCMSCEQCRQSNESLCSHASLSGYTVDGSFQQYAVGKAAHVARIPKDCDLAGVAPILCAGLTVYKALKSSNVRPGQSVVIAGAGGGLGVFAIQYAKAMGLHVTALDGGEEKRKVCTELGADTFIDFKTSADIVGEIKNATRGLGPDAVLLLAASEKPFQQASQYVKSKGTIVCVGLPANAFVKAPVFDTVVSIKGSYVGNRQDAAEAIEFYRQGLIHAPYKIVGLSELQKVYDMMIAGNIAGRYVVDTSR

SEQ ID NO: 17214 - protein, 315 aa, Shigella flexneri 2a str. 2457T
MDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 17215 - protein, 454 aa, Schizosaccharomyces pombe
MPEAFERYSSNPTYEPPWRKVRFIGIAGPSGSGKTSVAQLIVKALNLPHVVILSLDSFYKSLNAEQKKRAFNNDYDFDSPEAIDWDLLFVKLLELKQGRKVDIPIYSFNEHNRLPETNTLFGASIIILEGIFALYDEKIRSLLDVSVFLDTDSDVCLSRRLNRDINYRGRDIVGVLEQYNKFVKPSYENFVRRQLSYTDLIVPRGRDNKLAIDMVINFIRRTLSIQSETHVKNIDSLQQIVPTIPHLPLNLVQLKITPEISAIRTILINKNTHPDDLQFFLSRIGTMLMNLAGDSLAYEKKTITLHNGNQWEGLQMAKELCGVSVLRSGGTLETALCRQFPTVCLGKILVQINKVTQEPTLHYHKLPRGIATMNVVLMASHLTTHADVLMATQILVDFGVPEENIIIVVYVCYSESIKALAYIFPKVTIVTAFLESVAEPVVGRLDIEKVYYGC

SEQ ID NO: 17216 - protein, 486 aa, Chloroflexus aurantiacus
MTATAEDVLSTLPLRLLINGEWRDANNGATFAVINPANGTVLGYVPNAGVEETRTAIAAAVAAQPGWAATPAGERAALLRRVAQMMLDRQQELATIMTLEQGKPLAEARGEIAYAASFLSWFAGEAERIYGMTIPASTNAKRILVLRQPVGVVAMITPWNFPSAMITRKLGPALAAGCTVICKPAEQTPLSALALGQLFSEAGAPPGVINILTCQDPRPFADTIFADTRVRKISFTGSTEVGKELMRRSADTLKRVSLELGGNAPFIVFADADLDAAVRGAVASKFRNAGQTCVCANRIFVQRPIYAAFAERFAAEVNRLTVGDGLQPGVNIGPLIDDQARQKVERHVHDAIAAGARVLVGGGPAPLGGNFWLPTVLLDARSDMLVAREETFGPVAPLIPFDDEAEVIRMANDTPYGLAAYAFTRDVGRVWRLAEGLEYGIIGINDPIPSTAQAPFGGVKQSGIGREGGPTGIDEYLDIKYVSIGI

SEQ ID NO: 17217 - protein, 256 aa, Yarrowia lipolytica
MTREDNIYLARLSEQAGRYEDMVEYMKEIATGDQELSVEERNLLSVAYKNVIGAHRAWWRVVSSCEQKEEQKGKETKIIDDFRQKIEAGLQDICHDILNVLEKHLIPKLEKPSAEATEAAAKDGADPSELSESIVFYYKMKGDYYRYLAEFTTDDKRKEAAEKSLQAYQFASDEATSKLPPTHHIRLGLALNFSVFYYEILNSPERACQLAKQAFDDAIADIDSITEERSKDYALIMQLLRDNLTLWTNNDEPEQA

SEQ ID NO: 17218 - protein, 295 aa, Oryza sativa
PCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRRFPRRLMVNLPDASNREKILKVILAKEELAPGIDMDSLATMTDGYSGSDLKNLCVTAAHYPIREILEKEKKVGIACTLLSTEDLDKEKNVAKAEGRPEPALYGSEDIRPLTLDDFKSAHEQVCASVSSDSANMNELLQWNDLYGEGGSRKKKALSYFMSSGRPTFVLHR

SEQ ID NO: 17219 - protein, 269 aa, Zea mays
MDAPFFHELRRQASSYLTGKIRSARLALTDVTPTQLMTEEATNGDASPPNVKTMGLIARQAFEVDEYVRITDILHRRFASFDPRQGQGQWQWREAYKALLLLDHLLTHGPRSVAVEFQKDREAIERMATFQHIDERGFNWGRTVTSKSERVLKLLERGPFLEEERERARKIAREIKGFGSFNLSSASHAAPQPPPGDEGSRGYGRSNSQFEQRWRHKDGDDSDKENLIQSPEPARVAREVEAEPEEPHHHPFHGLGQKQRPEAMLLLSQ

SEQ ID NO: 17220 - protein, 839 aa, Oryza sativa (japonica cultivar-group)
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSYPPHIAAYRSGLEIDPNISKTDAEDGLRKELSGQRPLRITNKNLIDYLFTCSLEIAVSYHLPMQIHTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAESGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 17221 - protein, 401 aa, Triticum aestivum
  unsure (1)..(401): unsure at all Xaa locations
MRRVRVSSHHSPVQKLGDSHMKLTPKFRLTAATTSSPSSXDRSSLNLHGXTPLIPGLPDDAALNCLLRLPVEAHGACRLVCRRWRHLLADKARFFTHRKAMGLRSPWLFTLAFHRCTGKIQWKVLDLDPLAWHAIPGMPCRDRACPRGFGCIAVPGDAAAHLLVCGGLVSDMDCPLHLVLRYDVCRNRWAVVPRMLSARSFFAGGVIDGRVYVAGGYSTDQFELDSAEVLDPVNGVWQPIASMGTNMASSDSAVIGGRLYVTEGCAWPFFSSPRGQVYDPKADRWEAMPAGMREGWTGQSVVIDGRLFVISEYERMKVKVYDPEMDSWDPVDGPPMPERIMKPLSVSCLESKIVVVGRGLHVVIGHVKKQSSCDYLVRWQDVEVPRAFSDLTPSSSQILHA

SEQ ID NO: 17222 - protein, 212 aa, Triticum aestivum
  unsure (1)..(212): unsure at all Xaa locations
RTRGGSLTPAISVLSAVSGIREKAPNLTQLQVVWISVAILFLLFSVQRFGTDKVGYSFAPIILVWFVLIAGIGAYNLAAHDATVLRALNPMYIVDYFRRNGKQAWLSLGGVVLCTTGTEAMFADLGHFNIKAIQLSFSFIIFPSVALCYMGQASYLHKFPQDVADTFYKSIPRXGCSGPTFIXVAILAAIIASQAMLSGXAFAILSKALSFA

SEQ ID NO: 17223 - protein, 394 aa, Zea mays subsp. mays
LGAERRARLPPGEMGWPLVGGMWAFLRAFKSGKPDAFIASFVRRFGRTGVYRSFMFSSPTVLVTTAEGYKQVLMDDDAFVTGWPKATVALVGPRSFVAMPHDERRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQDVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 17224 - protein, 490 aa, Xanthomonas axonopodis pv. citri str. 306
MPRFPDQLLYIGGRYVPARGGHTLEVVNPATGEVLANVHNAGVDDLDAAVDSAKAGQQRWAALTTVERSRILLRAVALLRERNDALAQLETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDVAADIAMMANFYSSGQVCTNGTRVFVPRALRHAFEARLLARVQRIHIGDPLDERTTFGPLASAAHMQRVLEHIEQGKAEGARLLCGGERLQDGALVQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 17225 - protein, 310 aa, Oryza sativa (japonica cultivar-group)
MEMRRLLVLFALLSVTAVVPVFLWPDKKGGASDVAVVVAAPPFNASSVTIISWKPRIFFYKGFLSDDECDHLVKLGKEKLKRSMVADNESGKSVMSEVRTSSGMFLDKQQDPVVSGIEERIAAWTLLPQENAENIQILRYENGQKYDPHFDYFQDKVNQLQGGHRYATVLTYLSTVEKGGETVFPNAEGWESQPKDDSFSDCAKKGLAVKAVKGDSVLFFNLQPDGTPDPLSLHGSCPVIEGEKWSAPKWIHVRSYDNASSMKQSEECSDLSENCAAWAASGECNNNAVYMIGTEDAPGQCQKSCNACSL

SEQ ID NO: 17226 - protein, 627 aa, Xylella fastidiosa Ann-1
MIAQQSSSNSNSTIILSAIGVVFGDIGTSPLYTLKEAFSPNYGLAPNHDTVLGILSLIFWAMMLVVTIKYVTVIMRVDNDGEGGIMALTALTQRTMPFGSRSIYIVGILGIFGTSLFFGDGIITPAISVLSAVEGLEVAEPHMKAFVVPITLAVLILLFLCQRFGTERVGKTFGPITFLWFIAIGVVGVYNIIQAPEVLYAINPWWGLHFFLEHGWHSMFVLGAVVLAVTGGEALYADMGHFGAKAIRHAWMYVVLPMLALNYLGQGALVLSNPTAIGNPFYQSIPDWGLYPMIALATAAAVIASQALITGSYSLSSQAMQLGYIPRMNVRHTSQSTIGQIYVPTVNWTLLTLVILTVIGFGDSTSMASAYGVAVTGTMMITTVLMIIYARANPRVPRLMLLMIAIVFIAVDGAFFYANIIKFMDGAWFPLLLGVVIFTFMRTWLRGRKLLHEEMRKDGINLDNFLPGLMLAPPVKVPGTAVFLTADSTVVPHALMHNLKHNKVLHERNVFLTVKTLKIPYAANSERLKIEPISNGFYRVHIRFGFMETPDVPSALMCSKDHAGIDFDPMHTTFFVSRETVIPSANRGMPIWRDKLFVLMHRNAAPANAFFRIPGNRLVELGAQVEI

SEQ ID NO: 17227 - protein, 201 aa, Glycine max
MPSRQLSTPSDTPHPLPPPRHHHHHHHHFLTPLLAATVSTCSLFLLLLLFCHRTLTRKRATTYPPSPATTSPPHRLSFSVLRRATNSFSTRLGHGGFGPVFAGTLAGAPVAVKLMDSATNHHQGEREFHNELFFASKLLSRHVITATHFCSDPKRRRFLLVYELMHNGNLQDALLHRKCPELSNWNTRFSIILNIAKGVHF

SEQ ID NO: 17228 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 17229 - protein, 357 aa, Pinus radiata
MGSLETEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHMGVKIAKAFGLHVTVISSSDKKKEEAMEVLGADAYLVSKDTEKMMEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLEKNDVRYRFVVDVAGSKLDN

SEQ ID NO: 17230 - protein, 488 aa, Protectocarpus speciosus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYQRAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 17231 - protein, 186 aa, Brucella melitensis 16M
MKGLKMESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 17232 - protein, 475 aa, Synechocystis sp. PCC 6803
MYEKLQPPSVGSKITFVAGKPVVPNDPIIPYIRGDGTGVDIWPATELVINAAIAKAYGGREEINWFKVYAGDEACELYGTYQIFPEDTLTAIKEYGVAIKGPLTTPVGGGIRSLNVALRQIFDLYTCVRPCRYYPGTPSPHKTPEKLDIIVYRENTEDIYLGIEWAEGTEGAKKLIAYLNDELIPTTPALGKKQIRLDSGIGIKPISKTGSQRLVRRAILHAKRLPKAKQMVTLVHKGNIMKFTEGPFRDWGYELATTEFRAECVTERESWICGNKESNPDLTIEANAHMIDPGYDTLTEEKQAVIKQEVEQVLNSIWESHGNGQWKEKVMVNDRIADSIFQQIQTRPDEYSILATMNLNGDYLSDAAAAVVGGLGMGPGANIGDSAAIFEATHGTAPKHAGLDRINPGSVILSGVMMLEFMGWQEAADLIKKGIGAAIANREVTYDLARLMEPKVDKPLKCSEFAQAIVSHFDD

SEQ ID NO: 17233 - protein, 474 aa, Bolidomonas pacifica var. eleuthera
ESGVIPYAKMGYWDAAYSVKNTDILALFRITPQPGVDPVEAAAAVAGESSTATWTVVWTDLLTACERYRAKAYRVDPVPNTTDQYFAFIAYEIDLFEEGSLANLTASIIGNVFGFKAVSALRLEDMRIPHSYLKTFQGPATGIIVERERLDKYGRPVLGATVKPKLGLSGKNYGRVVYEGLKGGLDFLKDDENINSQPFMRWRERFLYCMEGINRAAAATGEVKGSYLNITAANQEEVYKRAEYAKAVGSVIVMIDLVMGYTAIQTAAIWARENDMILHLHRAGNSTYARQKNHGINFRVICKWMRMSGVDHIHAGTVVGKLEGDPLMIKGFYDVLRLTNLEVNLPFGIFFEMDWASLRKCMPVASGGIHCGQMHQLLYYLGDDVVLQFGGGTIGHPDGIQAGATANRVALEAMVLARNEGSDYFNEEVGPQILRDAAKTCGPLQTALDLWKDISFNYTSTDTADFAETPTANV

SEQ ID NO: 17234 - protein, 504 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSQPLAARNPEAQRAVQKKNLVVKQQTKPVEVIETKRNAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLSFSSHKSIVKSDQFCKKFNLCQEVTAPASEFHLGNCEAWRETVTKLKDPETKGSLVSRDFSSCKELLIKGFKMKECLAAKKI

SEQ ID NO: 17235 - protein, 355 aa, Burkholderia multivorans
MKIAVLPGDGIGPEIVTEAVKVLNALDEKFELEQAPVGGAGYEARGHPLPDATLKLAKEADAILFGAVGDWKYDSLERALRPEQAILGLRKHLELFANFRPAICYPQLVDASPLKPELVAGLDILIVRELNGDIYFGQPRGVRAAPDGPFAGEREGFDTMRYSEPEVRRIAHVAFQAAQKRAKKLLSVDKSNVLETSQFWRDIMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMLLRYSLNRAEQADRIERAVKTVLEQGYRTGDIATPGCKQVGTAAMGDAVVAAL

SEQ ID NO: 17236 - protein, 308 aa, Bradyrhizobium japonicum USDA 110
MAESPNDAATPASIVDALKAVAGNPPKVRASFAKGWCVRGTYTPSDRAEEITRSQSFTRPSRVLARFSVGGGNPNVADTNNLVLRGFSFKLGDDDHRSDILVESAPVHFARTLDQMLAFLKARIPGPDGKPDMAKVKAFSAANPETLNQANYIAARALPGSFAGTTYWGVHAFPATNEQGETRFIKFKVVPARGEITLSEDEARTKPADFLHDDLGTRIAAGNVRFNVMALLDRPGDPTMDVTIRWPDEDQRDEVRLGTIVITGFEPDQACDVTIFNPANLAEGIGHPPDEIFAARRAAYMISLAKRR

SEQ ID NO: 17237 - protein, 133 aa, Glycine max
MQLVFAPKQFDVIVTDNLFGDILSDQASMLTGSIGMLPSASLDANNKGMYEPCHGSAPDIAGQGIANPLATILSVSMMLRYSFNLFFSADAIEKAVSLVLDQGLRTDNIWSQGCTKVGTQEMGDAVVAALRNL

SEQ ID NO: 17238 - protein, 249 aa, Geobacter metallireducens
  unsure (1)..(249): unsure at all Xaa locations
MVQVCHQERCLQKQQDRNLHAEAPVRRQRFRHALPPVHLEERPEPLRRRQVRRALPDGPLVHRRHHQARXXXXXXXXXXXXXXXXXLCAITNPTTNSYKRLVPGFEAPVNMAYSSRNRSASIRIPMLSTNPKAKRIEYRTPDPSCNGYLAFAAMLMAGLDGIENKIDPGQPLDKDIYGLSPEELKDIPSAPGTLEDALNALRDDHEFLLKGDVFTPDVIEKWIEYKMEAEVNPVRMRPVPLEFALYYDI

SEQ ID NO: 17239 - protein, 491 aa, Pseudomonas syringae pv. tomato str. DC3000
MTTQPLNSHRVDPHTAQKFYIDGHWSAPLSPVSIAVVNPATEEVVAHVASGSAADVDRAVAAARAAFAGWSGTSPEVRAQVIGRIHELIIERKEELAQAISLEMGAAISSARAMQVPLAAEHVRVARDLLATYRFQTVEGGTAIEREPIGVCALITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFANAVPPGVMAAFRNVGQSCSAPTRMIVPRNRLAEVEALAAQTAGTIVVGDPQLEHTVLGPIANEAQFHRVQAMINAGICEGAKLVCGGPGRVQGHEQGFYTRPTVFSEVDSSMRIAREEIFGPVLCLIAYDTIDEAVAIANDTVYGLGAHVQGQDLELARSVASRIRAGQVHLNYPSWNPMAPFGGYKRSGNGREYGVHGFEEYLETKAIVGFAPADLM

SEQ ID NO: 17240 - protein, 432 aa, Triticum aestivum
  unsure (1)..(432): unsure at all Xaa locations
MAARAHNNVAAAQQQNRALGGGGGGGVPAMGKQQKAAMAGRPDPKNTRRALGDIGNFEANNRRAPLGDIAHVVDVRAAEGKPQPHEPVNRPVTRNFGAQLLKNAAGDCYXNPVARPAVRRAHHVKPAPPPPEHVIEISSDSDVTKSEAGSVSSVRKYSRKKVVTTLSHVLSARSKFAAGITEEPAIQDIDKLDGDNQLAVVDYIEDIYKFYKVAENECRAKDYMDSQVEINAKMRGILIDWILEVHQKFDLMPESLYLTVYIIDMYLSLQTVLRRELQLVGVSALLIACKYEEIWAPEVNDFILISDSAYTREQILKMEKAILNRLEWXNLTVPTPYVFLVRFAKAASSSDQKNDKXEMENTVFFFAELALLQYGLVQSKPSMVAAAAVYAARLTLKKTPLWTDTLKHHTGFTEAQLMDAAKILVASHSTGP

SEQ ID NO: 17241 - protein, 311 aa, Vibrio cholerae
MKVAVIGAAGGIGQALALLLKNRLPAGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTNRIQNAGTEVVEAKAGGGSATLSMGQAACRFGLALVKALQGESDVVEYAYVEGEGEYAPFFAQPIKLGKNGVEALLDIGKLSAYEQAALDGMLDTLKGDIQIGVEFVK

SEQ ID NO: 17242 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQESGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFCPERFLKLEGDSSGVVDVRGSHFQLLPFGSGRRMCPGVSLAMQEVPALLGAIIQCFDFQVVGPKGEILKGDDIVINVDERPGLTAPRAHNLVCVPVERRSGGGPLKIIEC

SEQ ID NO: 17243 - protein, 377 aa, Methanocaldococcus jannaschii
MFINGDVMLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 17244 - protein, 291 aa, Streptomyces galilaeus
MKGIILAGGSGTRLHPITVSVSKQLLPVGDKPMIYYPLSVLMLADIREILLICTERDLEQFRRLLGDGSQLGLRIDYAVQNRPAGLADAFVIGADHVGDDDVALVLGDNIFHGHHFYDLLQSNVHDVQGCVLFGYPVEDPERYGVGETDASGQLVSLEEKPLRPRSDLAITGLYLYDNEVVDIAKNLRPSPRGELEITDVNRNYLARGRARLVDLGRGFAWLDAGTPESLLQATQYVRTLEERQGVRIACVEEVALRMGFIDADMCHRLGEQMSQSGYGRYVMAVAREFSG

SEQ ID NO: 17245 - protein, 434 aa, Mycobacterium tuberculosis H37Rv
MIAIGGVIGAGLFVGSGVVIRATGPAAFLTYALCGALIVLVMRMLGEMAAANPSTGAFADYAAKALGGWAGFSVGWLYWYFWVIVVGFEAVAGGKVLTYWIDAPLWLASLCLMMMMTATNLVSVSSFGEFEFWFAGVKVATIVGFLVLGTAFAFGLLPGHGMDFSNLSAHGGFFPDGVGAVFAAIVVAIFSMTGTEVVTIAAAEAPDPQRAVQRAMSTVVARIVIFFVGSVFLLTVILPWNSLELGASPYVAALRHMGIGGADQIMNAVVLTAVLSCLNSGLYTASRMLFVLAARQEAPAQLVKVNRRGVPTFAIMGSSVVGFLCVIMAWVSPATVFVFLLNSSGAVILFVYLLIALSQIVLRRQTSGQNLGVRMWLFPGLSIVTVTGIVAVLARMAFDYAARSQLWLSLLSWAVVVGCYLVTTLVRRPLNRPW

SEQ ID NO: 17246 - protein, 329 aa, Eremothecium gossypii
MNDSDLKQRVKFVAPENDTASSYSTKETTFLQDGTVAAAITATRAIREVSSLCSWDDLPDWQKDNEHILSGYVRETNSYRKTFRSLFYLHNESVNIYSHLIPGICFLFIALFNKYVVADYSTTTWKDYLMIDIFLLGAVVCLTLSGVYHCMKSHSLEVSVFGNKLDYIGIVALISCSMISQMYYGFYDSTAMFSLFSTVTLSLALACAVVSLSPHFRSREWRKYRAAIFTAFGLSGLLPVITSCFYYGPIEAYSRIQLKWLSLEGVLYISGAVLYGVRFPEKLEPGSFDIWGHSHQLFHVLVVIAALCHLRALLSCYKNVHTNALFVSL

SEQ ID NO: 17247 - protein, 337 aa, Oryza sativa (japonica cultivar-group); identical to SEQ ID NO: 7794

SEQ ID NO: 17248 - protein, 240 aa, Oenococcus oeni MCW
MQNYSDNRIIKDVTDSTNESGLAAFFQRTYAYMGAALLITFGLAYALAYPFYAEFVRFYASNGALTWIVLAIAQLAVVFLIGRNALKNPALAFGGLLAFAVVEGIFFGAIFAMYDLQSIVSAFLMAAVDFGAMALYGFFTKKNLSRLAPILFGAMIALMVGLVVSIFVPGFSFIMSVLGVLVFSVYAAYDNNRLKQMYFELQGQGNQTINGLAISGALSLYLDFVNLFLYLLRIFGNQRN

SEQ ID NO: 17249 - protein, 331 aa, Saccharum sp.
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 17250 - protein, 176 aa, Geobacter metallireducens
MGKRIMPWLLAGLFMAPPAAIGKEARTMSELQISSPAFTHKGAIPARFTCDGQDINPSLAFGNIPAGTKSLALIVDDPDAPVGMWVHWVMWNIPPETREIRENSVPADAIQGLNDWKKNRYGGPCPPSGTHRYFFKLYALDSKLTLAPATTKTALERAMTGHILARGELMGTYRRH

SEQ ID NO: 17251 - protein, 396 aa, Pisum sativum
MFGNGNCDVDNEKTIITSSKWTQSEIDDHKVSMASSTGNRVMEKPGQELLQQQQQALRCPRCDSSNTKFCYYNNYSLTQPRHFCKACKRYWTRGGTLRNVPVGGGCRKNKRLKRPTYPCSNNNNIDFSASPSSSTPSSVVANPNPPSQSQQQQQQQQHHSFDIAATSNHINTMLYGGNSCHDVMNFPFSTRFNSTTRVSNPASGYDNLPQNGLGLGFSSGILMSAAGGEVNLNHHHHHHHDEGSYRNGFSTSNNNNYSSIFGSSSTTTPVMASLLSSTLLQQKFMGTGGGIKGGGGGGGGDDDPFHHHQEMDSKEVKLGEGLQNRLDQWNMNNLNGNGGAVFQNQMENMGLSDNNASLYWNNNHNNSNNNTSATATGLSSVWSTDQPGSNSVSSLI

SEQ ID NO: 17252 - protein, 425 aa, Brucella melitensis 16M
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 17253 - protein, 86 aa, Triticum aestivum
YSQQLLNTLTHALQSSGIDLSQANISVQINLGKRAVKRPTAGQSSSFKEHTDLGPTNNMMGHQQAMLGNATEELPHATKRYKPGNT

SEQ ID NO: 17254 - protein, 367 aa, Glycine max
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKFKCVATTPSPPEIPLSFFEFEGQILRQL

SEQ ID NO: 17255 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLYTL

SEQ ID NO: 17256 - protein, 90 aa, Zea mays
  unsure (1)..(90): unsure at all Xaa locations
IFGNMQNLYETVKKAQMVVQVEAVRVQKELAXVTLSGNQQPIRVEITEAAMELGAEKLSELVNDAYKDAHQRSVQAMKERMSDLAQSLGM

SEQ ID NO: 17257 - protein, 250 aa, Leptospira interrogans serovar lai str. 56601
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAELF

SEQ ID NO: 17258 - protein, 350 aa, Listeria monocytogenes EGD-e
MTYKITSLAGDGIGPEIMTSGLQVLEAVAKKYNHTFEIESHPFGGAGIDVAQDPIPSSTLKACQDADAILLGAIGGPKWDNAPKRPEDGLLALRKALGLFANIRPIQVPSSITHLSPLKKEIVENTDFVVVRELTGGLYFGEPKHWDESAAVDSLTYTRAEIERIIEKAFEIAATRNKKVTSVDKANVLASSKLWRKIAEEVASRHPDITLEHLYIDAAAMLMIQRPTTFDVIVTENLFGDILSDEASVITGSLGMLPSASHAENGPSLYEPIHGSAPDIANQNIANPMSMISSVSMMLRQSFSLFKEADAIDAAATRTMQAGFLTADLGGNTTTTDFTNEVLKQIEGGE

SEQ ID NO: 17259 - protein, 212 aa, Triticum aestivum
  unsure (1)..(212): unsure at all Xaa locations
VHHRLMLMPETLYLTVYIIDQYLSXENVLRKELQLVGVSAMLISCKYEEIWAPLVKELLVLSDNAFSREQVLSTEKSILNKLQWNLTVPTVYVFLLRYAKAAMGDKELENMAFFYAELALVDYSMLVYSPSVTAAAAVYTARCTLNMSPGWSDILEHHTGLGESQLMQCARRLASLHSTAAGSSKQKVVYNKYANPKLGAVSLYSPAKRLAI

SEQ ID NO: 17260 - protein, 352 aa, Suillus bovinus
MGNCVSAQDREEKARSDAIDRQIEEDSRKFRKECKILLLGSGESGKSTIVKQMKIIHQNGFNENELMTFRPTIYRNTLDSAQAIVLQMRNMNVECATPANRTFAERIVEYRVENTPDFVFSADIAQAIHELWQDPIIPKVMDCSSQFYLMDSAGYFFTEVLRIGTPDYIPTENDVLRARAKTTGITETRFNMGQLSIHMFDVGGQRSERKKWIHCFESVTSIIFCTALSEYDQVLLEEKNQNRMQESLILFESASTPAGLRTSIILFLNKIDVFKNKLPKVPIEKYFPEYTGGADINKAAKYILWKFMQANRARLSVYPHLTQATDTTNIRLVFAAVKETILQNALKDSGIL

SEQ ID NO: 17261 - protein, 378 aa, Thellungiella halophila
MLSTLMKLLSACLWPSSSGKSSDSTGKQDGLLWYKDSGQHLLGEFSMAVVQANNLLEDQSQVESGPLSTLDSGPFGTFIGIYDGHGGPETSRFVNDHLFQHLKRFAAEHASMSVDVIRKAYEATEEGFLGVVTKQWPVKPQIAAVGSCCLVGVICGGRLYIANVGDSRAVLGRAMNATGEVIALQLSAEHNVSIESVRQEMRSLHPDDSHIVVLKHNVWRVKGLIQISRSIGDIYLKKAEFNKEPLYTKYRLREPIKRPILSGEPSITEHEIQPQDQFLIFASDGLWEQMSNQEAVDIVQNHPRNGIARRLVKMALQAAAKKREMRYSDLKKIERGVRRHFHDDITVVVIFLDTNVVSSAKGPSLSIRGGGMTFPKKL

SEQ ID NO: 17262 - protein, 412 aa, Glycine max
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKSIKVVSSRDPLKLPWAELGIDIVIEGTGVFVDGPGAGKHIQAGAKKVIITAPAKGADIPTYVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYRLVGT

SEQ ID NO: 17263 - protein, 257 aa, Zea mays
PAGDVRTALAMAPPRRPSMGRQKIEIRRIESDEARQVCFSKRRAGLFKKASELSILCGADVAAVVFSPAGKAFSFGHPSVESVVDRFLASSTPSPAGAGAGAGHSSAGGGEDRAVSELNRQHGDLRAQLDAEKARQERADEAIRKEREAGSPAMAWIDADLGAMGHDDLVAFWAALAGVQAAVAASADQLLRDALLVGRRGRQQQQPAAQLGGGGVAFDVGAFGIGVQVPPPPGFAGVDLQGFGGQAAAILGAGGPS

SEQ ID NO: 17264 - protein, 282 aa, Zea mays; identical to SEQ ID NO: 16640

SEQ ID NO: 17265 - protein, 409 aa, Vibrio vulnificus CMCP6
MELTTTVSELRYALDTFFFLISGALVMWMAAGFAMLEAGLVRSKNTTEILTKNFCLYAIACTTYLVVGYNIMYVDNSEGGWLPSIGALIGSQAEGADHSLESDFFFQVVFVATAMSVVSGAVAERMKLWSFLLFSAILTAFIYPVEGYWTWGGGFLSAAGFSDFAGSGIVHMAGAAAALAGVLLLGARKGKYGKNGEVYPIPGSNMPLATLGTFILWFGWFGFNGGSQLMVSDFENATAVGQIFLNTNAAAAAGAITALLVCKTTWGKADLTMILNGALAGLVAITADPLSPSPLYAVAIGAVAGALVVFSIVGLDKLKIDDPVGAISVHGVCGFFGLMVVPISNGDASFLSQLFGAAVIFAWVFGASLAVWAVLKATIGIRVSEDEEMEGMDMHDCGVGAYPEFVTVK

SEQ ID NO: 17266 - protein, 337 aa, Triticum aestivum
MAPLGDAVAPAAATAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVRVSKDDSIFYNEAKLREVLQFSNACGAICTTKKGAIPALPTTATALELISKGSN

SEQ ID NO: 17267 - protein, 513 aa, Brassica napus
QTLSQLLDPTTAILIIVSLFIFIGLITRRRRSYPPGPRGWPIIGNMLMMDQLTHRGLANLAKKYGGLCHLRMGFLHMYAVSSPHVARQVLQVQDSIFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGISKRLVKARNDLDGFIDDIIDEHMKKKENQNTVDDGDVGDTDMVDDLLAFYSEEAKLVSETTDLQNSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMINAFAIGRDPKSWPDAETFRPSRFLEPGVADFKGSNFEFIPFGSGRKSCPGMQLGLYALELAVAHILHCFTWKLPDGMKASELDMNDVFGLTAPKATRLFAVPSTRLICAV

SEQ ID NO: 17268 - protein, 366 aa, Archaeoglobus fulgidus DSM 4304
MAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 17269 - protein, 380 aa, Bacillus subtilis subsp. subtilis str. 168
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 17270 - protein, 253 aa, Zea mays; identical to SEQ ID NO: 3990

SEQ ID NO: 17271 - protein, 598 aa, Vibrio parahaemolyticus RIMD 2210633
MAITSEFLQSSVVFLSAAVIAVPLAQRFGLGSVLGYLLAGVLIGPWGLRLISDVDAILHFAELGVVLLLFLIGLELNPKKLWQMRGPILGLGGAQVVVTTAVIGSIVSLFDLSMQVSLVIGMGLALSSTAIALKVIEEQGLNGTETGQSGFAVLLFQDIAVIPMLAMLPLLAGEQNVGSWFDAFTVLGSVVALLIGGHFLLRPLFRFVVMSGVRELFTVASLLVVLGISVVMQKLGLSMALGTFLAGVLLAESEYRHELEIAIEPFKGLLLGLFFIAVGMAVNLGLLALHPLEILGAVVALVVVKGLVLYALARAGRVREKARSRMAAILSQGGEFAFVIFTAASQEGILSKEQVAFLLVVVSLSMVTTPLLLMGQKKWFAHTLNQEEESVTSHVVDRRPRVIIAGFGRFGQIVGRLMYANKIKVTVLESDASQIHLLRKYGYKVFYGDATQIDLLRAAGADKAEALVICTDSPDEVMAIVDICRTHFPNLKLLARARSRVEAYQLMSHGVQNYSRETFLGALDLGRQTLVELGMHPYQAKRAEAHFRKLDNAMLKDLLPQHNEDKKLAQRAKEARKELEEIFGREMESDHQSPNHWK

SEQ ID NO: 17272 - protein, 138 aa, Escherichia coli
MCELVDEMSCHLVLTTGGTGPARRDVTPDATLAVADREMPGFGEQMRQISLHFVPTAILSRQVGVIRKQALILNLPGQPKSIKETLEGVKDAEGNVVVHGIFASVPYCIQLLEGPYVETAPEVVAAFRPKSARRDVSE

SEQ ID NO: 17273 - protein, 109 aa, Salmonella enterica
NLFSGDKYAGLSEQALYYIGGVIKHAKAINALANPTTNSYKRLVPGYEAPVMLAYSARNRSASIRIPVVASPKARRIEVRFPDPADNPYLCFAALLMAGLDGIKNKIHP

SEQ ID NO: 17274 - protein, 122 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 17275 - protein, 297 aa, Saccharomyces cerevisiae
MTGEDFKIKSGLAQMLKGGVIMDVVTPEQAKIAEKSGACAVMALESIPADMRKSGKVCRMSDPKMIKDIMNSVSIPVMAKVRIGHFVEAQIIEALEVDYIDESEVLTPADWTHHIEKDKFKVPFVCGAKDLGEALRRINEGAAMIRTKGEAGTGDVSEAVKHIRRITEEIKACQQLKSEDDIAKVAEEMRVPVSLLKDVLEKGKLPVVNFAAGGVATPADAALLMQLGCDGVFVGSGIFKSSNPVRLATAVVEATTHFDNPSKLLEVSSDLGELMGGVSIESISHASNGVRLSEIGW

SEQ ID NO: 17276 - protein, 458 aa, Fucus gardneri
  unsure (1)..(458): unsure at all Xaa locations
AAYNVKGPDILALFRITPQPGVDPVEAAAAVAGESSTATWTVVWTDLLTACDIYRAKAYRVDPVPGTNDQYFAYVAYECDLFEEGSLANLTASIIGNVFGFKAVKALRLEDMRIPYAYLKTFQGPATGVVVERXRLDKFGRPLLGXTVKPKLGLSGKNYGRVVYEGLTGGLDFLKDDEXINSQPFMRWKERFLYCMEGVNRAAAATGEVKGFYFNVTAATMENMYERAEYSHAIGSVICMIDLVVGYTAIQSMAIWARKAEMILHLHRAGNSTYARQKKHGINFRVICKWGRMCVVXHIHAGTVVGKLEGDPLMVKGFYNTLFLTELKINLAEGLFFDMDWASLRKCVXVASGGIHCGQMHQLLYYLGDDVVLQFGGGTIGHPDGIQAGATANRVALEXMVLARNEGRDYVGEGPXILRTAGSTCGPLKAALDLWKDITFEYTSQDTPDFVEVATESN

SEQ ID NO: 17277 - protein, 300 aa, Gymnodinium simplex
RIGRQVARIAMKDPETELKLINASYDADYLAYMMKYDTIHGKYDGSIEVDGDSLVIDGKKVALSHTRDPAEIPFGEHGADYVCESTGVFLTTEKVQPHLKAGAKKVVFSAPAKDDSHTIVMGVNEDTYKPEMECVSCASCTTNGLAPAVRVLQEKFGIKRGLMTTCHAMTASQPTVDGTSKKDWRGGRAGPGNIIPSSTGAAKAVAKVIPAVKGKLTGMALRVPTIDVSVVDLTCELEKETTYEEICAEMKRRAEGDMKGFLGYTDEALVSTDFETNPISCTFDSKAGIMLDPTFVKVVC

SEQ ID NO: 17278 - protein, 54 aa, Glycine max
  unsure (1)..(54): unsure at all Xaa locations
MFIERFKXVESPNGKYPETEIQSVYHYETTGLVHENHNGTYQGGGQPQNGKYEI

SEQ ID NO: 17279 - protein, 361 aa, Oryza sativa; identical to SEQ ID NO: 6500

SEQ ID NO: 17280 - protein, 423 aa, Penicillium janthinellum
FVKNSGICETTPGVNQYSGYLSVGSNMNMWFWFFEARNNPQQAPLAAWFNGGPGCSSMIGLFQENGPCHFVNGDSTPSLNENSWNNYANMIYIDQPIGVGFSYGTDDVTSTVTAAPYVWNLLQAFYAQRPEYESRDFAIFTESYGGHYGPEFASYIEQQNAAIKAGSVTGQNVNIVALGVNNGWIDSTIQEKAYIDFSYNNSYQQIIDSSTRDSLLDAYNNQCLPALQQCSQSGSTSDCTNADSVCYQNIEGPISSSGDFDVYDIREPSNDPYPPKTYSTYLSDPTVVKAIGARTNYQECPNGPYNKFASTGDNPRSFLSTLSSVVQSGINVLVWAGDADWICNWLGNYEVANAVDFPGNAQFSALDLAPYTVNGVEKGQFKTVDNFSFLKVYGAGHEVPYYQPDTALQAFKQIIQKKPISST

SEQ ID NO: 17281 - protein, 299 aa, Aeromonas hydrophila
MTLGDKMKAVIPVAGLGTRMLPATKAIPKEMLPIVDKPLIQYVVNECIAAGIKEIILVTHSSKNAIENHFDKSFELEATLESRVKRQLLEEIQSICPKDVTIMHVRQGEAKGLGHAVLSAYPLVGDNPFVVVLPDVIIDDAASDLKKDNLAKMVRNYIESGHSQIMVEPVDAKDVSKYGIVDCHSIDVNAGESATIFDVVEKPEQDDAPSNLAIVGRYVLTPEIWSHLRTTKPGAGDEIQLTDAISELLKNGQVDAFCMQGKSHDCGDKLGYMKAFVEYGLRHKEYQHSFKEFIGSLAL

SEQ ID NO: 17282 - protein, 331 aa, GIBBERELLA ZEAE PH-1
MVSFKVFRGTPEGKIVADNVERELENHEVFIETTHSGVCGTDKLYMTSGVVLGHEGVGIVKAVGSAVTNVKNGDRVGFGYTHQICGHCDNCCTDRDQYCRDRQIYGFSDFNNGSFSYGAVWDSKTVCPIPEGYDSADAAPLLCAGSTVWTCLTQYGLRPLESVGIVGIGGLGHLAIKLAAAMGNHVVVFSSSESKRQEAMDYGASEFHVYKSGDKAPEGLKPVKHLLLCGSANIDYSGLASIVDYDGSIYPLTAALEATPVPLTELSLKGIRIQGSLVGSRDSVRKLLEFVARKNITPTTMKYSLNEEGIEKALHDLKDGKVRYRAVLVKE

SEQ ID NO: 17283 - protein, 378 aa, Desulfitobacterium hafniense
MHGGNLLDASAQYGRQNFIDLSANINPFGPPQGVWEALQKGVANIIHYPDPNYRRLRGKMAEYYALNAEEILLGNGAGELIFLILHGLRPRKVLIPQPAFSEYERAALACGAEVNKLILGVKGWGELSFQNEESHREWEQALAENELVFINSPHNPTGSALSKQQFEVILNLALKHQTWVVLDESFVDFLEDESRWSGKGYLRRYPNLLVLYSLTKFYAIPGLRLGAVFGAAKLLGRLQDQRDPWAVNSLAEEAGLAALADAEYGKRVRRLLQESKESFYRSFAEGRKGKKYWGLRLYSSKVNFALIQVLEAEDSGTDRDDAGKGKKNLIQELGKQGILVRDCGNFAGLEGNYIRVAIKDQESMNSLLAGFKMLDNLC

SEQ ID NO: 17284 - protein, 475 aa, Arabidopsis thaliana
MAGAYDPSLPEVPEWLNKGDNAWQLTAATLVGLQSMPGLVILYASIVKKKWAVNSAFMALYAFAAVLLCWVLLCYKMAFGEELLPFWGKGGPAFDQGYLKGQAKIPNSNVAAPYFPMATLVYFQFTFAAITTILVAGSVLGRMNIKAWMAFVPLWLIFSYTVGAYSIWGGGFLYQWGVIDYSGGYVIHLSSGVAGFVAAYWVGPRPKADRERFPPNNVLLMLAGAGLLWMGWSGFNGGAPYAANLTSSIAVLNTNLSAATSLLVWTTLDVIFFGKPSVIGAIQGMVTGLAGVTPGAGLIQTWAAIIIGVVSGTAPWASMMIIHKKSALLQKVDDTLAVFYTHAVAGLLGGIMTGLFAHPDLCVLVLPLPATRGAFYGGNGGKQLLKQLAGAAFIAVWNVVSTTIILLAIRVFIPLRMAEEELGIGDDAAHGEEAYALWGDGEKFDATRHVQQFERDQEAAHPSYVHGARGVTIVL

SEQ ID NO: 17285 - protein, 188 aa, Streptococcus pyogenes MGAS315
MILLIDNYDSFTYNLAQYLSEFDETIVLYNQDPNLYDMAKKADALVLSPGPGWPKEANQMPKLIQDFYQTKPILGVCLGHQAIAETLGGTLRLAKRVMHGRQSTIETQGPASLFGSLPQEITVMRYHSIVVDQLPKGFSVTARDCDDQEIMAFEHHTLPLFGLQFHPESIGTPDGMTMIANFIAAIPR

SEQ ID NO: 17286 - protein, 514 aa, Glycine max
  unsure (1)..(514): unsure at all Xaa locations
LHWPFVLVSISKSTTTPSLLFSIIIISTPFTLSHSSLESSTAMATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTXDKDGWYPPGHGDVFPSLLNSGKLDALLSQGKEYVVCCQFRXLGEHIVDLKILNHLIQNKNEYCMEVTPKTLADVKGGXTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKISIVSNPGVKLEVPDGAVISDKEINGPEDL

SEQ ID NO: 17287 - protein, 516 aa, Cicer arietinum
MASMAAIGVLKVPPSSSSSSSSSSSKAIIARNLSFTSSQVCGDKIGTFSRRGRGSYVGNPIIVSPKAVSDSKNAQTCLDPDASRSVLGIILGGGAGTRLYPLTKKRAKPAVPLGANYRLIDIPVSNCLNSNVSKIYVLTQFNSASLNRHLSRAYASNMGGYKNEGFVEGLAAQQSPENPNWFQGTADAVRQYLWLFEEHNVLEYLVLAGDHLYRMDYERFIQAHRESDADITVAALPMDELRATAFGLMKIDEEGRIIEFAEKPKGEQLKAMKVDTTILGLDEERAKEMPYIASMGIYVVSKHVMLDLLREKFPGANDFGSEVIPGATNIGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGSVPIGIGKNSHIRRAIIDKNARIGDNVKIINSDNVQEAARETEGYFIKSGIVTVIKDALIPSGTVI

SEQ ID NO: 17288 - protein, 110 aa, Zea mays; identical to SEQ ID NO: 14516

SEQ ID NO: 17289 - protein, 200 aa, Phaseolus vulgaris
MADQGLEGIQPVDLQRHPSGIVPTLQNIVSTVNLDCKLDLKTIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 17290 - protein, 74 aa, Lycopersicon esculentum
CRAAVPSGASTGIYEALELRDGGSDYLGKGVSKAVNNVNSIIGPALVGKDPTDRAGLDNFMVHQLDGTQNEWGW

SEQ ID NO: 17291 - protein, 829 aa, Magnetococcus sp. MC-1
MTLDEQLSESSVHEHDRPDWNATFIKEKLVNYMVHDVGKDPDIASERDWYYAVVYFVRGVLSERRIRQNRYLRDEKGRRVYYLSMEYLIGRNLMRTVLDLDLNILLREALSEFEQDLDTIVACEVDAALGNGGLGRLAACILDSIANQSFPGMGYGIRYEFGMFSQSIEEGMQVEHPEHWLRHGNPWEFEQPNVKYRVRFNGKILCFKDADGNDTCQWVDTKDVVALAFDVPLSGHKTPSITNLRLWSARATRDFDLSYFNEGNYVEAVKDKAVSENLSKVLYPNDSTLRGQELRLKQEYFFVSSSLQDIMERFKLENGDIRQFPKRVVIHLNDTHPSLAVPELLRLFCDEYGLEFDEAWDLCRQTFTYTNHTLLPEALETWPIAIMEHVLPRHLQILYKINHQHLKEVKHRYPGNSTILSRMSLIDDVSKRVRMAHVCIVGSYSVNGVAELHSRLMQAGMFKDFKEMRPGVFTNVTNGIDQHRWLNMSNPGLSALIKESIGDKWVSDLPALVELAPLADDAGFRRQFHDIKRANKVRLAQLVARKTGVELDPSSMFDVQVKRIHEYKRQLLNLMHVVTRYIRIRDGVENDMVPRSVIIGGKAAPGYHIAKQIIRLINDVASTINNDPAIKGLLKLVFLPNYNVSKAEIIMPGSELSEQISTPGMEASGTGNMKFALNGALTIGTLDGANIEILEEVGDDNIFIFGMTADEAHDLRAGGYDPTLYFEKNAELRRVLEMIRDGFFCPDDPGRYSDLYNNLLFGGDHFLLLADYEAYIACQKQVEATYSNQDRWNRMAVLNTANMGKFSIDRTVRTYAENVWKVKPMQLKR

SEQ ID NO: 17292 - protein, 616 aa, Glycine max
MTIHSVVIQKLLSTNAQVGRRVAAHHLKEFTYGFRNKMAIIDSDKTLICMRSACNFMASLARHNGRFMFINTNPLFDEIFDLMTKKVGSYSPSTNSLWRTGGFLTNSLSPKKFRSRNKKLVFGPTQPPDCIFIVDTERKSSVINEAFKLQIPVVALVDSAMPLDVYKRIAYPVPANHSVQFVYLFCNLITKTLLHEKAKSDAANPDIDAQMEEAPRKGKGKTYLDKVDVTVVLYDNLAPLPQDIEETKKLLDKLVVLKFNGSQGRNMCFDGPKSAIDICDGLTYLDLIINQIETLNSKYGSRVPLLLFNKDDIHDSSLKVLEKYSKSSVEVHTFKQGEDRELKSLGEYYSKEEVHPFDDVDVFRLLMTGGTLDSLLSQGKEYILVLKSDNVATVLDPNILNHLMINDIEYCMEVTPSNSFNLMLPTTKFKLREIGGDQDKHLKDNFKLIDTTNMWVSLRAIKRFVDTVEVRQKKPSFSKDTAAGPAIKFFDNVFGVSVPESRFLPLDATSDLLLLQSDLYTCREGVLTRNPARTNPLNPVIDLGPEFEKFGDFQSRFRSIPSIIELDSLMVRGDVWFGANITLKGQVTIAAKPGLKLEIPDGVTIENKEINDPADI

SEQ ID NO: 17293 - protein, 506 aa, Zea mays
MVSGQKGTGFSVPVAVVTPLSAPAEERCARRETREGEGRRRGGVVVKSMPPPSPLLRSSAFVVLLLLVCRPLLVANGRATPPSPGWPPAAQPALQPAPTASGGVASVLPSAVAPPPLGVVVAERHHHLSRELVAAIILSSVASVVIAIAALYAFLLWRRSRRSLVDSKDTQSIDTARIAFAPMLNSFGSYKATKKSAAAMMDYTSLEAATENFSESNVLGFGGFGSVYKANFDGRFAAAVKRLDGGAHDCEKEFENELDLLGKIRHPNIVSLVGFCIHEENRFVVYELMESGSLDSQLHGPSHGSALSWHIRMKIALDTARGLEYLHEHCNPPVIHRDLKSSNILLDSDFSAKISDFGLAVTSGNHSKGNLKLSGTMGYVAPEYLLDGKLTEKSDVYAFGVVLLELLLGRKPAEKMAQSQCRSIVTWAMPQLTDRSKLPNIIDPMIKNTMDLKHLYQVAAVAVLCVQPEPSYRPLITDVLHSLVPLVPTELGGTLRIGPESPYLRY

SEQ ID NO: 17294 - protein, 488 aa, Chnoospora implexa
MPEDVQNRTRIKSERYESGVIPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIIMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAASCGPLKAALDLWKDITFDYTSTDTPDFVEVATGSR

SEQ ID NO: 17295 - protein, 279 aa, Zea mays
MTMAGSCAAPPVACLPSLRTLPPTHVRLSGFLPCSSAARSRGAAVLGCALGTKRQTPGVLNRLFCGYMQRDGHEGDVSCQGRDDTVMFGPDDDGVKIPTQVETLVKGTAMVAEPEYKASPDLDYLQELLAIQQQGPRAIGFFGTRNMGFMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAMNLRKIVTLFYLD

SEQ ID NO: 17296 - protein, 161 aa, Zea mays
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVEPSLFPMLGKWEREHTMEDILASLKREMSTPQNRRLYQPHEGNEDQRVEQKGLSLRCVVM

SEQ ID NO: 17297 - protein, 296 aa, Glycine max
MAVFLFWDISSQIRKLFLFFRFLVSHPNLMEGSVNERLDFGKMGYGCNHYRRRCRIRAPCCNEIYSCRHCHNDAASLLKNPFDRHELVRQDVKQVVCSVCDTEQPVAQVCTNCGVKMGEYFCNICKFFDDDVEKEQFHCDDCGICRVGGRDNFFHCKKCGSCYAIGLRDNHLCVENSMRHHCPICYEYLFDSLKDIIVMKCGHTMHSECYLEMLKRDKYCCPICSKSVMDMSRAWKRIDEEIEATVMPDDYRYRKVWILCNDCNDTTEVYFHILGQKCGHCSSYNTRAIAPPVLSQ

SEQ ID NO: 17298 - protein, 120 aa, Glycine max
  unsure (1)..(120): unsure at all Xaa locations
FGTNKAAQLASSMISSPAVTTVNRAGAGMVAPFTGLKSMAGFPTXKTNNDITSIASNGGRVQCMQVWPPVGKKKFETLSYLPDLDDAQLAKEVEYLLMKGWIPCLEIQLEQRFVFREPHQ

SEQ ID NO: 17299 - protein, 469 aa, Methanosarcina mazei Goe1
MSKNVQKIEKLLIVICMIFIVLPSPALAVTAEENAEAIEGLQTTLTFLWLLIASGLVFFMHAGFSLVETGLTRSKNTANILMKNFMTVVLGILVYWAVGWGVMYGADAAGLIGTDQFFLAGADNATWNSWFFQMVFAATGATIVSGAMAERTNFKAYLVYCVLMVAVIYPIYGHWVWSGADTALLSGADSPIVKAIGVAHHDFAGSGVVHSIGGYSALAGVLLVGARIGKFRDGKAIPIPGHNLTIAFLGTLILALGWLGFNGGSTLNANDPYMNLVVVNTFLAGAVGAVTTMAITWMKTGKPDPSLTANGLLGGLVAVTAPCGSISNWGAIAIGIIAGIIIYAGVMFNENKLKLDDPVGAIAVHGYCGTWGLISVGLFSIGIGNGILADASYAAAVPGLFYGGGVSLLLIQLVAVLITIVWGFGLSFIIFKILDAVIGLRVSEEEEIMGLDICEHGIRAYPEYLMREE

SEQ ID NO: 17300 - protein, 282 aa, Escherichia coli
ALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEQSALEGMLDT

SEQ ID NO: 17301 - protein, 460 aa, Chondrus nipponicus
RDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANV

SEQ ID NO: 17302 - protein, 235 aa, Zea mays
MTVLDAESRFHVLAVDDSIIDRKLIEMLLKSSSYQVTTVESGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHELELEEAAADRNGVNKRKAAAMEEGLTVVVTAPESTKPRRLSTSSLTVET

SEQ ID NO: 17303 - protein, 197 aa, Triticum aestivum
ARAPEVFEGSYYDVNSDETEKQLALLSNSEHSSSTNSSGSDDWVEPAAYVLNSTALLTREHRNVLDAFRLLQRDPNVQKMVMSLSCDRTVWDAVMNNEAVQEFRRSFQDGKEVNRKGNSCGPAVVLKGILASTQAKRAEFFDNIAQIVSKLFHPQSGEDKPDLYSDAVKVSFMLSVFVFIVAAVARTNYEPWDFEVW

SEQ ID NO: 17304 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 17305 - protein, 485 aa, Microbulbifer degradans 2-40
MSLTLTNSKLQRQGSVIDGAWLQSSDEFVVENPATGQVVATVANAGAAEAEAAVLAAERAGVQWREFSAKKRSTLLKAWYELVVSNANDLAVLLTTEQGKPLAEAKAEILYGASYIEWFAEQAKRIEGAVIPAPASNQRIVTVKQPVGVVAAITPWNFPMAMLARKIAPALAAGCTVVAKPAKETPLSALAMAYLAQEAGIPPGVINLVTGQDSSAIGGVFTQHPSVKKLTFTGSTAVGKTLLEQSAATIKKCSMELGGNAPFIVFDDADIDAAVAGCIAAKFRNAGQTCVCVNRIFVHDKVKAAFTKKLVEAVAKLKVGDGIEEGVAIGPLINAAAFKKVSELVIDACNKGAKAIVAEGHTHLNGALFYPPTVVTEATTQMDVFNEEIFGPVAVVYSFSSEEEAIALANNTPFGLAGYFYSRDIGRVWRVASALEVGMVGVNDTAISNEMAPFGGVKESGFGREGSQMGLDDYLETKYMLMGGL

SEQ ID NO: 17306 - protein, 656 aa, Synechocystis sp. WH 8501
MENIKMGEEWSILAPEEIGSQDFFTDLLEDLYQRFLEVKEGENATYIPELAKADPDLFGISIMTTEGRIYSIGDTSELFTIQSISKPLVYGMVLEELGEEYVINKIGVEPTGEPFNDIMEPREIQERKYNPMVNAGAIITTSLIKGDTLEEKQEKLFNMFSRYLGRNVNLKESIFWSRKTGDSWNRAIAYMMLNFGLIEGNVEEILDLYFQQCSILVNCQDLALIAAILANKGLNPITGQRTINENYTKNLLSVMFTSGLYDFSGQWAYRVGLPAKSGLSGSIIGVIPNKMGIAVFSPPLGTQNKSVRGVKIFEEISQRFKLHIFKPDYSNNPLNKKKKVISSLFKKQDYLPSFLQHLYDKYLPLQEGKIYVSEPDLVEHDPNCFSICIVTVDGTVYTVGESEKPFLIQSISKVFAYGMALEDHGRDYILTKVEVEPTGDSYNSIIKVEENSKRPYNCMVNTGAIAMTSLIKGKSPAHKLNRLLKMYQRYVGHPVYVDTSAVVSEQNQGDRNWAISYLLRNFGMISGDIKQTLDLYLQQCSAIINCRDLAVMAATLANQGINPITDQSAINPEYVKDLLSVMFTCGMYDFAGEWCYKVGFPAKSGVGGGILGVVPGVMGIGVFSPPLDKRGNSIRGIKVCEELSQQFQLHIFQPLN

SEQ ID NO: 17307 - protein, 355 aa, Botryotinia fuckeliana
MMCFGSREDVEAKRSKEIDALIHRDEKVMQRQVKLLLLAGAGESGKSTILKQMRLIYTDKGFSKTEKEEWRIIIFHNILDGLRMTVEAMNDFNTPFEHENTKQYLPMITEEKDLRPCEPIPLEYLKAFKDMWADSGIQKTVERGNEFALHDNLGYFFEDLDRLFSKEFVPTDQDVLRARLRTTGITETHFDLGSLQYRMFDVGGQRSERKKWIHCFENVNALLFLVAISGYDQCLAEDKDENQMQEALMLWESIANSHWFKHSALILFLNKIDLFKAKIGHSPITKFGFSDFQGDTTSWQQTSKYFMDKFIALNRSPGREVYGHFTNATDTDLLKVTMSSVQDMIIQRNLQKLIL

SEQ ID NO: 17308 - protein, 554 aa, Neurospora crassa
MRISASTVLLGAASAASAASFQNQAQHVLADNFHKAHDAVKPVADSFAHTTLESFEEAFNGMNSQAKALWDEIKLLVPENAFDKPTWFSKPKAAKRRKDWDHVVKGADVQKLWVKGADGEKHREVGGQLDNFNLRVKSVDPSKLGVDKVKQYSGYLDDEENDKHLFYWFFESRNDPKNDPVVLWLNGGPGCSSLTGLFLELGPSSIDKKLRVVSNEYAWNNNASVIFLDQPVNVGYSYSGNAVSNTVAAGKDVYALLTLFFHQFPEYAKQDFHIAGESYAGHYIPVFASEILSHKDRNINLKSVLIGNGLTDPLTQYEHYRPMACGEGGYPAVLSESECRSMDNALPRCQSLIRNCYESGSVWSCVPAAIYCNNQFIGPYQRTGQNVYDIRGKCEDDSNLCYSALGWISDYLNQKDVMDALGVEVEGYESCNFDINRNFLFQGDWMQPFHRLVPGILKEIPVLIYAGDADFICNWLGNKAWSEALEWPGKNGFNKAELEDLSLPKADKEYGKVKSSGNFTFMQIYQAGHMVPMDQPENSLDFLNRWLGGEWFEQ

SEQ ID NO: 17309 - protein, 519 aa, Zea mays
  unsure (1)..(519): unsure at all Xaa locations
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 17310 - protein, 217 aa, Brucella melitensis 16M
MKFFVDTADVKEIRELNDLGLVDGVTTNPSLILKSGRDIIEVTKEICNIVKGPVSAEVAATEYEQMMKEAAVIARIADNICIKLPVTLDGLKACKALTSEGHKVNMTLCFSANQALLAAKAGATFISPFIGRLDDTGINGMELIAEIRTIYDNYDFRTEILAASVRTVNHVKEAALIGADVVTAPPATLKALVKHPLTYKGLETFLADWAKTGQKIA

SEQ ID NO: 17311 - protein, 387 aa, Oryza sativa
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTYMQFAPSDQVRNC

SEQ ID NO: 17312 - protein, 243 aa, Bacillus licheniformis
MSYRVKRVLLLLVTGLFLSLSAVTSTASAQAGGSFFDTFNSYNSGVWQKANGYSNGGVFNCTWRANNVSMTSLGEMRLGLTSPSYNKFDCGENRSVQTYGYGLYEVRMKPAKNVGIVSSFFTYTGPTDGTPWDEIDIEFLGKDTTKVQFNYYTNGVGNHEKLVDLGFDASNSYHTYAFDWQPNSIKWYVDGQLKHTATSQIPTTPGKIMMNLWNGIGVDDWLGSYNGVTPLYAHYDWVRYTKR

SEQ ID NO: 17313 - protein, 349 aa, Triticum aestivum
  unsure (1)..(349): unsure at all Xaa locations
RHPTHPPPAPPPSPLLPPLFSSLRLAAQHTASEACAGSTVDGRGDSGGGTQLEPASSPFDVVVGLAGTAPGGARTHVHAGQQRRVGEDGGGGAVVARERAPPDIRXAQGRLARVCPPGRLMPHQRRPAHLRHRGQAPPGTPSRAPTPRPSGPSTAYTREGLTLAAGAHHIAKHNXRVPFVCGXRNLGEALRRIRRGXAAMIRTKGXEAGTGNVIEAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGEAMVGINLSDPKVERFAARSE

SEQ ID NO: 17314 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 17315 - protein, 325 aa, Corynebacterium glutamicum ATCC 13032
MSKQHSTPLNNDEEHTSAPQKVAVITTGGTIACTSDANGHLLPTVSGADLLAPIAPRFNGAQIAFEIHEINRLDSSSMTFEDLDSIIATVHKVLEDPDVVGVVVTHGTDSMEESAIAVDTFLDDPRPVIFTGAQKPFDHPEADGPNNLFEACLIASDPSARGIGALIVFGHAVIPARGCVKWHTSDELAFATNGPEEPERPDALPVAKLADVSVEIIPAYPGATGAMVEAAIAAGAQGLVVEAMGSGNVGSRMGDALGKALDAGIPVVMSTRVPRGEVSGVYGGAGGGATLAAKGAVGSRYFRAGQARILLAIAIATGAHPVTLY

SEQ ID NO: 17316 - protein, 350 aa, Mesembryanthemum crystallinum
EDEACSYAMTITSGSVPPMVLKAVIELDVLEIIKRAGPGAQLSPAEIANQLPTKNPDAATMLDRMLRLLASYSILSYSLRTLSDGRVERLYGLAPVCQFLTKNQDGVTLGALSLMNQDKILMESWYHLKDAVLDGGIPFNKAYGMSAFEYHGTDPRFNKVFNSGMSNHSTITMKKILDDYQGFEGLSTLVDVGGRHWGYPNMIISKHTTIKGINFDLPHVIEDAPAYPGVEHVEGDMFVSVPKGDAIFMKWICHDWSDEHCLSFLKNCYAALPNHGKVIVCEYILPVAPETSHAARTVFHVDAIMLAHNPGGKERTEQEFQALAKGSGFEGFKVACSAYDTKVMEFLKQN

SEQ ID NO: 17317 - protein, 394 aa, Zea mays
MGSFVKLARRAVETDAPVMVKIQELLRGAKDVMSLAQGVVYWQPPESAMAKVEKIIREPTLSKYGSDDGLPELREALFEKLRRENKLTKSSVMVTAGANQAFVNLVLTLCDAGDSVVMFAPYYFNAYMSFQMTGVTDILVGGSDHKTLHPDVDWLEKVLKENDPIPKLVTVVNPGNPSGAFIPRPMLERISDLCKNAGAWLVVDNTYEYFMYDGMKHYCLEGTHIVNLFSFSKAYGMMGWRVGYIAFPNEVDGFHDQLLKVQDNIPICASIIGQRLALYSLEAGPEWIKERVRDLVKNRALLVDALSPLGDGNVRGGQGAIYLWAKLPDTCSDDFEVVRWLANRHGVAVIPGSASGGPGHIRVSFGGLKEEDTRLAAERLRRGLQELVADGTVQ

SEQ ID NO: 17318 - protein, 202 aa, Raphanus sativus
MLEEVKDSNGNPVRVGAQYFIQPVKTESNNGGGLVPAATNILPFCPLGITQTLLPYQPGLPVSFGYHPNILGRDTIDTSADINIEFRSPIWPVCTEFSKLWAVDSSSASKEPAVIIGGEPKSPNSAFKIEKAAGAHTYKLTTSSGTVGTTPGAWLSAPQLLVTNDVAKTLFVKFVKVDNDATTATTSTSRVEKLGLKMFPFY

SEQ ID NO: 17319 - protein, 135 aa, Glycine max
MHFLGIGIGCCSNDVVGQLELSPTMSNSSSSLSMELDESPESRIQRLISEHPVIIFTRSSCCMCHVMKKLRAPIGDLPTAIDCMCHVMKNLLATIGVDPTVIELDDQEIAPRTLPDPPRQRPPLRRLVQVGALWV

SEQ ID NO: 17320 - protein, 216 aa, Oryza sativa; identical to SEQ ID NO: 6649

SEQ ID NO: 17321 - protein, 425 aa, Vibrio vulnificus CMCP6
MSDDNSQQMTPEEVLRQQALDYHALPTAGKIAVALTKPAETAKDLALAYSPGVAEPVREIAQNPDNVYKYTSKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLNECIIVCLGAGAAAVACMELLIKCGAMREKIYMLDRKGVIHTRRDDLNEYKQLFANNTDKRTLEDVISGADLFLGVSGPNLMPAEALKLMADKPVVFACSNPDPEIKPELAHEVRSDLIMGTGRSDYPNQVNNVLCFPFIFRGALDVRASEINDEMKLAAVEAIRQLAKEPVPEAVLKAAGVESLSFGPQYIIPKPMDSRLLPRVAKAVAQAAVDTGVARIPMPENYMAE

SEQ ID NO: 17322 - protein, 61 aa, Gossypium barbadense
LGANAILAVSLAVCKAGAEVKKLPLYKHIANLAGNSKLVLPVPAFNVINGGSHAGNKLAMQ

SEQ ID NO: 17323 - protein, 312 aa, Oryza sativa
  unsure (1)..(312): unsure at all Xaa locations
MGEEKVAPKSDAAPAVELLGFVMSAEEAERAAAAAGVETVEDLLPLLVPSAMRRARAPISRFPVGAVGLGASGRVYAGVNLEFRGLPLSHSVHAEQFLVVNAAAAGESELRAVAVSHMPCGHCRQFLQEIRGAGGIRIIVTSDAEDGCAPEWRTVAXLLPRPFGPHDXLPKHVPVVLEPHDNPLGEPASVANGFAHGDLEARLREAAEAAARAAHAPYSECPSGFAVADGEGKVYAGGCLESAAYNPTLGPVQAAIIGMVAAGGGAAGDVVAAALVEKEAGLVSQEATARIFLAAVAPQATFHVYNYTPSDA

SEQ ID NO: 17324 - protein, 468 aa, Phyllariopsis purpurascens
IPYAKMGYWDADYNVKDTDILALFRKTPQPGVDPVEAAAAVAGESSTATWTVVWTDLLTACDIYRAKAYRVDPVPGTNDQYFAYVAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATIEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQPLYYLGDDVVLQFGGGTIGHPDGIQSGATANRVALEAMVLARNEGRDYVGEGPEILRNAASTCGPLKAALDLWKDITFDYTSTDTPDFVEVPTGSN

SEQ ID NO: 17325 - protein, 397 aa, Chlamydomonas reinhardtii
MALTMSAKSVSARAQVSSKAQAAPAVAVSGRTSSRVMPAPALAARSSVARTPLVVCAATATAPSPSLADKFKPNAIARVPATQQKQTAIITGASSGLGLNAAKALAATGEWHVVMACRDFLKAEQAAKKVGMPAGSYSILHLDLSSLESVRQFVQNFKASGRRLDALVCNAAVYLPTAKEPRFTADGFELSVGTNHLGHFLLTNLLLDDLKNAPNKQPRCIIVGSITGNTNTLAGNVPPKANLGDLSGLAAGVPAANPMMDGQEFNGAKAYKDSKVACMMTVRQMHQRFHDATGITFASLYPGCIAETGLFREHVPLFKTLFPPFQKYITKGYVSEEEAGRRLAAVISDPKLNKSGAYWSWSSTTGSFDNQVSEEVADDSKASKLWDISAKLVGLSA

SEQ ID NO: 17326 - protein, 508 aa, Saccharomyces cerevisiae
MKYLNLVFVLQLLISIKYASFGRAFSLFEDDTTFANLDKQLKLPQNTQQTLKLDRLNHDDPLFTTFISSVDTDYSLRLRTVDPSKLGIDTVKQWSGYMDYKDSKHFFYWFFESRNDPANDPIILWLNGGPGCSSFTGLLFELGPSSIGADMKPIHNPYSWNNNASMIFLEQPLGVGFSYGDEKVSSTKLAGKDAYIFLELFFEAFPHLRSNDFHIAGESYAGHYIPQIAHEIVVKNPERTFNLTSVMIGNGITDPLIQADYYEPMACGKGGYHPVLSSEECEKMSKAAGRCRRLNKLCYASKSSLPCIVATAYCDSALLEPYINTGLNVYDIRGPCEDNSTDGMCYTGLRYVDQYMNFPEVQETLGSDVHNYSGCDNDVFTGFLFTGDGSKPFQQYIAELLNHNIPVLIYAGDKDYICNWLGNHAWSNELEWINKRRYQRRMLRPWVSKETGEELGQVKNYGPFTFLRIYDAGHMVPYDQPEASLEMVNSWISGNRAFSDLSTLENAS

SEQ ID NO: 17327 - protein, 275 aa, Escherichia coli
IGQALALLLKTQLPSGSELSLYDIAPVTPGVAVDLSHIPTAVKIKGFSGEDATPALEGANVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSA

SEQ ID NO: 17328 - protein, 179 aa, Coprinopsis cinerea
MMTSRALGLGSALRTAAFTPRTLRNQVVLRNSITRRFVQTESLTPAENLQLLNKQRLKRPSSPHFTIYQPQLTWLGSIAKRVTGAGLSVLLYGFSIAYLIAPGTFDSAHVVEFVAGLPDGVKYAGKAILAAPFSYHAWNGLRHLAWDAGKFLSVKGAYATGYAVLGLTGVSTVVLTFFK

SEQ ID NO: 17329 - protein, 193 aa, Serratia marcescens
MADILLLDNVDSFTYNLVDQLRASGHQVVIYRNQIGAEVIIERLQHMEQPVLMLSPGPGTPSEAGCMPELLQRLRGQLPIIGICLGHQAIVEAYGGQVGQAGEILHGKASAIAHDGEGMFAGMANPLPVARYHSLVGSNIPADLTVNARFGEMVMAVRDDRRRVCGFQFHPESILTTHGARLLEQTLAWALAK

SEQ ID NO: 17330 - protein, 480 aa, Pseudomonas syringae pv. syringae B728a
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVRKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEEGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 17331 - protein, 552 aa, Mycobacterium tuberculosis H37Rv
MSDNAKHHRDGHLVASGLQDRAARTPQHEGFLGPDRPWHLSFSLLLAGSFVLFSWWAFDYAGSGANKVILVLATVVGMFMAFNVGGNDVANSFGTSVGAGTLTMKQALLVAAIFEVSGAVIAGGDVTETIRSGIVDLSGVSVDPRDFMNIMLSALSAAALWLLFANRMGYPVSTTHSIIGGIVGAAIALGMVSGQGGAALRMVQWDQIGQIVVSWVLSPVLGGLVSYLLYGVIKRHILLYNEQAERRLTEIKKERIAHRERHKAAFDRLTEIQQIAYTGALARDAVAANRKDFDPDELESDYYRELHEIDAKTSSVDAFRALQNWVPLVAAAGSMIIVAMLLFKGFKHMHLGLTTMNNYFIIAMVGAAVWMATFIFAKTLRGESLSRSTFLMFSWMQVFTASGFAFSHGSNDIANAIGPFAAILDVLRTGAIEGNAAVPAAAMVTFGVALCAGLWFIGRRVIATVGHNLTTMHPASGFAAELSAAGVVMGATVLGLPVSSTHILIGAVLGVGIVNRSTNWGLMKPIVLAWVITLPSAAILASVGLVALRAIF

SEQ ID NO: 17332 - protein, 364 aa, Populus balsamifera subsp. trichocarpa X Populus deltoides
MGSTGETQMTPTQVSDEEAHLFAMQLASASVLPMILKTAIELDLLEIMAKAGPGAFLSTSEIASHLPTKNPDAPVMLDRILRLLASYSILTCSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 17333 - protein, 491 aa, Escherichia coli CFT073
MMSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 17334 - protein, 412 aa, Salmonella typhimurium
MFMEFSAGLMPLETALTQMLSRITPLTAVETLPLVNCFGRILATDIVSPLDVPGFDNSAMDGYAVRVADLSADKPLPVAGKAFAGQPYQGEWPAGTCIRIMTGAPVPAGCEAVVMQEQTEQTDDGERFTADVRCGQNIRRRGEDIRQDAVVFPAGTRLTTAELPVLASLGIADAQVVRKVRVALFSTGDELQLPGQPLEADQIYDTNRLTIHLMLQQLGWREVINLGIIPDDPGKLRGFIDADSQADVVISSRVSEGEADYTKTILEELGEIAFWKLAIKPGKPFAFGKLSNSWFCGLPGNPVSAALTFYQLVQPLLAKLGGNTASAVPPRQRVRTASRLKKTPGRLDFQRGILQRSANGELEVTTTGHQGSHIFSSFSLGNCFIVLERERGNVEPGEWVEDEPFNALFGGL

SEQ ID NO: 17335 - protein, 396 aa, Odontella sinensis
MKLSLGIVALMAASASAFAPTAFMPANTLRAAAPASPSALNMALKEGEKPIVIGVAADSGCGKSTFMRRLTSIFGGEGVGPLGGGFDNGGWETNSLVSDLTTVLCLDDYHLNDRNGRKVTQRTALDPLENNFDLMYEQIAALKNGESIEKPIYNHVNGTLDTPETIVPTPIVIIEGLHPMYDERVRDLLDFSLYLDISDEVKLNWKIQRDMEERGHSLESILASIEARKPDFDAYIAPQKEFADLTIEVLPTQLDEEDKKTLRVRCIQKEGVSDFSPCYLFDEGSTIAWTPAPSKLSSSGPGLTMAYGTEDYYGKPAQVVEMDGTFDNIQELVYVESQLSNTSTKFYGELTQAMLKLADAPGSNNGTGLMQTLAAFAIRELYEKKAAAAKLAVIEA

SEQ ID NO: 17336 - protein, 446 aa, Zea mays
MAAAAGDGAGEARARALLQQHRPFATPPGEYHHFGAPSAATDEMVEAVVLRTPLKRKHNDRTENEAAESNDWMSPGYANAGSSPVPTPPSGKGLKASTKPKATKGQKSGPQTPLGFGSPGNPSTPVGGCRYDSSLGLLTKKFLNLLKGAPGGIVDLNNAAETLEVQKRRIYDITNVLEGIGLIEKKLKNNIRWKGVDDSRPGEVSDDMSILQADIDALTLQERNLDERISEMRDRLRGLTEDENNQKWLYVTEEDIKSLPCFQNQTLIAIKAPHGTTLEVPDPDEVNDYPQRRYRIVLRSTMGPIDVYLVSQFEEMSGMETPPRPTQTISMDSLENPRTPLAADCNKVTGMESNIHGGLILPSDAPSSSQDISGMMKIVPSELDADTDYWLLSDNTGVSMTNMWETGPDEWDGIEKFNAEDFLEVGTPQQQDKPADVVDDDPSCII

SEQ ID NO: 17337 - protein, 324 aa, Triticum aestivum
  unsure (1)..(324): unsure at all Xaa locations
KVLTLXYAPGIKINNLAVLDSRGYSRSLIASRSIESYLIQILKTGFFHADPHPGNLAIDKDGSLIYYDFGMMGEIKSFTRDRLLSLFYAVYEKDANKVIKALIDLEALQPTGDLSPVRRSVQYFLDNLLSQSPDQQQTLAAIGEDLFAIAQDQPFRFPSTFTFVIRAFSTLEGIGYILDPDFSFVKVAAPYAQELLDLKTRRRAGPELVQEIRKQANDARDSTISMPYRIQRIEDFVGQLESGDLKLRVRVLESERAARKANVLQMATMYTAMGGTLLNIGVVMGSQGNQIVANGSFIGAGIFLALLVASMRRVKKLEKFETMM

SEQ ID NO: 17338 - protein, 394 aa, Zea mays subsp. mays
LGAARRARLPPGEMGWPLVGGMWAFLRAFKSGKPDAFIASFVWRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 17339 - protein, 1104 aa, Neurospora crassa
MPVAGARALLSAQSSCCRRLPRAVSGSLSRRQHASHPSLRGFRTSAASLKNDSDSNSNPADHKKPEDEDKTTHDKPASTTTTTSTGQEEASADKKDTESKAAADAYKEALTLKGTRGRHRPGRMGAVNIENNVAPQASSTPSTPWVKLDPWFIDHNVSLYEARPIGAPQTMLFPLEDVDREAVLELLEKKFAKVQMTAEDVKSWTSMLDELVRLPEEEREAAFEQLPESSSQLLKKAHAAHSTAFLQALAIVHQTGANPEHIELLREHHSSREDDIVRLLWWSDKPLSGEAQRWLANLRCEAQPGSGALHGSPLASRPDPEYPVCMELLAAIRAELVADVPHGTKPPDYHRLTTVLSVVNRRGRSVANHVIDDIATDLKADVIHLDAFSLARLLGTQLQQNIHHARGSVSMLGYAASEMNGRLINRDDADSDGDVGVLHVSMPSKLRSLLSSGKDFGSSRSVDPRWEGLKIQNTLKAIVRAADAKRFAQTGTYEKRDLIIHLHDYVELSELQESLITRLRDIVHDWHFEEAAHDGKKIVLVGSSSSDMDKSQHWRNQLVELGREGHHIIPFHASPSTEWMDRKDNLYDNINNIKSMLEARLPTPAAIDFDAQIKFEDDQVLVDERYTDLFQTLSKHVFDAQWVYRLTSLLLGSRSPPPKKYGLGHLKYALAFMSDRDNHWKGIYSGIRPPYFSPLFRQKGGASNIFDQHMPEGGDSPTSGFSSSWASSQSQTASDNKDYDQHEKKLLAGLVNAKDIHTTFDDIIVPAETKESLIGLTSLSLQRPDAFAYGVLKTERIPGCLLYGPPGTGKTLLAKAVAKESGANMLEVSAASINDMWLGQSEKNVRALFSLARKLSPMVIFLDEADALLGARHNNPGRTAHRETITQFLREWDGLSDMRAFIMVATNRPFDLDEAVLRRLPRKILVDLPLVAERAKILKVMLREEQLAPDVDLDALAKETDLYSGSDLKNLCVSAAMEAVREECRAKEAHDAAMAAAVAAHSEKEEEGSNRPAYEFPERRVLTRKHFEKGMREISASISEDMESLKAIRKFDEQYGDAGGKAARRKARRGIGFEVAGTGRGGTEEARVRKVVVDEDGKGVKVAV

SEQ ID NO: 17340 - protein, 175 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNTNNGRLPIPVHRPNGTTNAGTLPTTSTSMPQSQSQTVVVENPMSVDSSGKLVSNVVVGVTTDKK

SEQ ID NO: 17341 - protein, 483 aa, Ralstonia sp. U2
MKTKLFINNTWSASSDKKSFDRKHPVSGEVVTQCANATVDDAVNAARAAQEAFKSWKAVGPSERRRLLLKVADVMESKTPEFIEVMAKEVGASALWAGFNVHLSANVFREAASLATQIQGETIPTDKPDTLSMTLRHAVGPILSIVPWNGTAVLAARAIAYPLVCGNTVVFKGSEFSPGTHALITKCLQEADLPAGVLNYLNSSPDRSPDIADALISSKEIRRINFTGSTRVGRIIAQKSAQHLKRCLLELGGKSPLIVLDDADIDAAVKAAVFGSFLFQGQICMSTERLVVDEKIADEFVAKFVEKTKQLSAGDPCVTGDCIIGPMVSPNSGDRINGLFKDAISKGAKVVCGGIAEGAVMPATILDHVTADMQIYDEETFGPITVVIRCKSEADAIRIANDSAYGLSSGVFGRDVNRALRVGMAIEYGSVHINGSTVQNEAQAPYGGTKATGYGRFDGRAVIDEFTELKWLTIEPFEQQYPF

SEQ ID NO: 17342 - protein, 192 aa, Pseudomonas aeruginosa UCBPP-PA14
MAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 17343 - protein, 144 aa, Glycine max
MAISSSSEIGWSWRVLCQRVNPAIPNTPLFLQIPKSTRFTGSSSVVARAWDPKTASSQVKSTQFIYFIYYRINEFSANDVKQEEDLVYVGKLVAGSFAGGAAIKYGSALFPEITTPNLVLALLLILTPVLVAVFLLIKESRTNP

SEQ ID NO: 17344 - protein, 197 aa, Oryza sativa; identical to SEQ ID NO: 4995

SEQ ID NO: 17345 - protein, 865 aa, Schizosaccharomyces pombe
MVIEKRESFIEVVINSLLNDNPAQAKFDKYSILVSLGFSSLLSVILLCIFTLLRTKFNTYDRCIPPMKKSLWGWIEPLWSIKVEDCLYNMGADAVISLLFSRFCRDVFLILAAICCTILIPINIVATNKTLANSDSQNAYAKLSIQNVTGNWTWAHVVICYVFNVLVLFLLARYYQIVMRIRQRYYRSPTYQQSMSSRSLLIMDIPTTMRSNNGLSILASRLKSSEAPMHVHICHAIKNLPKILKKHDNAVRSLEAVLAKFFKNPKKLPDDRPVRRVKQGLLTSEKVDAIDYYSAKIENYGLRVDAARESLYENEFEHYGFITYKSSYIAHDTARHNSRVAGASVSMAPEPSDFLWDNLSLAWSTRLFNRMIGNILFIILIIAWIIETALVAIFISNLYHLGSVWPWLQQQLTSRSGFWSIVQGILSPAVAGFTFMILEIIMRRISYWQGSFTKSSRERGVLNKLHIIFTLDNFIIYTLMAVFWRLGVIIAYKTKEEGNFAEGMSAFATFDTVGLSVSSFVQFSTFWIMFIAHSTCSFFVEIAQPITLTIRLIKTKFFSPTPRDLLEWTAPTKYVYSQVLNKLIYFFTIAICYACINPLVLLFASVLFCVNYLTQKYILMYVSNSSTESGGGYWRPVVNRILLGLELANIILFLCLWVQGGRVRAYCIIPNFSFAIAFKIWCMFALDPKSHYMIEDPYMKVVEPLENEISESEMCFGHPSTYAPLLVPMVRSDARALLPLFYSGRTETHNKFDFATDSDDASEKHLRGEEEPLENVDFVDIDNVDTAKEVHDQQQVQQLKKNLSRSYTRSRGVSLRARLNEEELPLTESITQDSQISIPETLESQSTEITPINVSEHYDKYYHIF

SEQ ID NO: 17346 - protein, 422 aa, Triticum aestivum
  unsure (1)..(422): unsure at all Xaa locations
MAAASFTAAKFLAPVAARSGGDRARPSPAPSAFAVRPLRRGPARRLGSVMAVSSDVLKAAPAAAAYPAVTREEALELYEDMILGRNFEDMCAQMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIIFVVENNLWAIGMSHLRSTSDPEIWKKGPAFXGMPGVHVDGMDVLKVREVAKEAIDRARRGEGPTLVECETYRFRGHSLADPDELRRPDEKSHYAARDPITSLKKYIIEQNLASEAELKSIEKKIDDVVEEAVEFADASPLPPRSQLLENVFADPKGFGIGPDGKYRCEDPKFTQGTAQV

SEQ ID NO: 17347 - protein, 427 aa, Coxiella burnetii
MTELTGVSIVTYQHIKVPSQGEKITVNKAVLVVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 17348 - protein, 607 aa, Brucella melitensis 16M
MNAGKHEAEANAGQAQDAGHPREMTGAEMVIQALIDQGVESIFGYPGGAVLPIYDGLFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 17349 - protein, 345 aa, Bacillus cereus ATCC 14579
MKAVVVNKNSKANIEVIEKELRPLHSGEALVDVEYCGVCHTDLHVANHDFGNTDGRILGHEGVGIVTKIADDVTSLKIGDRVSIAWMFQSCGRCEYCVTGRETFCREVKNAGYSVDGGMAEQCIVTADYAVKVPEGLDPAQASSITCAGVTTYKAIKVSDIKPSQPIVIYGCGGLGNLAIQYAKNVFGAKVIAVDINDDKLALAKEVGADMTINPISQGPADKIVQEKFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKKHNCDCK

SEQ ID NO: 17350 - protein, 476 aa, Saccharopolyspora spinosa
MPAQAAVIDGKLVEGPETLDVLDPSTGTLLDRTLRGTGEHVDAAVAAARAASREWAHTPYSERSAILRRIGELIRRDRGEFALLESQDTGKPLAQACADTDVAARYFEYYANTMEAFFGHSLPPNGDFVAYTRHVPFGVTGHIIPWNYPLQIGCRTIAPAIAVGNCAVVKPAEEAPLSVLKVARTALEAGLPAGVLNVVPGLGAQAGAALAGHAGIDHLSFTGSVPVGAAVAHAAAENVIPVVLELGGKSPNIVFPDADLDAAIPVIVKSMLQNAGQTCSAGSRLLVHEEVRDEVLARIDEALRGVRIGPGPQDLDLGPLISAKQRDRVTQMVQRAADSGARQLGGPGQVELPEGGFYFPPTVFTDVDPAQEIAQEEVFGPVLAAMSFGTVDEAIQLANGTQYGLIAAAWTRNLDVAHVMAEEIRAGQVYLNTYGGGGGVEYTFGGFGKSGYGREKGFEALKGFCQTKTIVTKVTR

SEQ ID NO: 17351 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHGRASPETMRDIRGFAVKFYTREGNFDLVGNNTPVFFIRDGIQFPDVVHALKPNRKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWTSYWLKADRSLGQKLASRLNVRPSI

SEQ ID NO: 17352 - protein, 52 aa, Zea mays
MVLEATMICIDNSEWMRNGDYAPSRFQAQADAVNLICGAKTQSNPENTVRRE

SEQ ID NO: 17353 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 17354 - protein, 359 aa, Capsicum chinense
  unsure (1)..(359): unsure at all Xaa locations
NMSYRVPFAALLEATSNFDESLVIGIGGFGKVYKGVLYDGTKLAVKRGNPKSQQGLAEFRTEIEMLSQFRHRHLVSLMGYCDEKNEMILVYEYMENGTLKSHLYGSDLPSMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKKGQLEQIIDPTLVGKIRPDSLRKFGETAEKCLADFGVDRPSMGDVLWNXEYALQLQEAVIQDDPEENSTLLIGELSPQVNDFSQVDAGASAALIGTPNLDDLSGVSMSRVFSQLVKSEGR

SEQ ID NO: 17355 - protein, 272 aa, Oryza sativa
  unsure (1)..(272): unsure at all Xaa locations
MDVLDAGHRATPEPSSSSSSAAAADMSGASVLPLAGAAYQPYVSELLSFSIERLHKEPELLRVDAERVRRQMQEVAVENYGAFIAASEALSFVRAQLEGFDRHLEALIEEIPNLTSGCTEFVESAQQILEERKLNQTLLANHSTLLDLLEIPQLMDTCIRNGNYDEALDLEAFVSKISKLHPDLPVIQGLAVEVKKTIQSLISQLLQKLRSNIQLPECLRIVAHLRRIGVFSESELRXREAWLSGILDDLDQRNVYGYLTGMVGYHRTHLFD

SEQ ID NO: 17356 - protein, 292 aa, Desulfovibrio vulgaris subsp. vulgaris (strain Hildenborough)
MPVNIRKVVIPVAGWGTRSLPATKNIPKEMLPVYNKPVVQYVVEEAQKSGIGDVVFVTNRDKKIIEDHFDYNLQLESVLERAGKTEMLRQVREVAEMVNIISVRQKKQLGLGHAVLCAREIVRDEPFAVMVGDDLMFGMTPGIQQLIDVAVAEHLPVIGVMEVPADKVSRYGIIAGEETAPGIYKVSRLVEKPSIAEAPSRLAIVGRYVLTPDIFDSLEKVKPGHGGEIQLTDALQNLADDRGLLAVKIRGMRFDAGDWAEYLTANIYFALQEEGLRDDLISQLRPLLPFRC

SEQ ID NO: 17357 - protein, 275 aa, Glycine max
MGTPGNDQPGTQTPQNAKSSPLFRYNSPFIQIVLIGLVCFCCPGMFNALSGMGGGGQVNATASNNALTALYTTFAIFGILGGGIYNILGPHLTLFAGCSTYVLYAGSFLYYNHYQHQFFAIVAGAILGVGAGLLWAAQGAIMTSYPPENRKGTYISIFWSIFNMGGVIGGLIPFILNYNRGDSAATVNDGTYIGFMVFMSVGAVLSLTILPASKVVRNDGTRCTNMLYSNVATESVEILKLFYNWKMLLIIPAAWSSNFFYTYQFNHVNKPQFNL

SEQ ID NO: 17358 - protein, 164 aa, Hordeum vulgare subsp. vulgare
MAQESLRLVCPPVSAHDGRLPRQYTLEGQGAKKDISPPLEWYGVPGGARSLALVVQDIDADERVPWTHWVVANISPEEKGLPEGFSGAGGNANAGGEGGLQEGVNDWKQPGWRGPVPDSHGHRIQFRLYALDDVLSLGNKVTVDKVMEAIEGHVLGEAELTAVF

SEQ ID NO: 17359 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 17360 - protein, 224 aa, Oryza sativa
MVGTSSWSSSSSSSLGSLDDDIIVACVVKAADAAVEGACVKFLCSYGGRILPRHADGALRYVGGDNRVVSVDRSLPFHELQRKLREMCGWEAVCLRCQLPTEDLDALVSVNGDDDLANLLEEYDAASRDRLQPLKIRAFLFPRTTATTTAPLSRSPSPTAASRTAPRAHYQHQTGSAPSCASRWAARQMSLPPARVPHQQQHYNRHGGDARPQRYLVQSASSRW

SEQ ID NO: 17361 - protein, 478 aa, Oryza sativa
MGPTSRNQKSSQKDAAPNEAKPPRYPQRNRSITASASASAFASPAVANSRVAKERPSSSTAGEGEPQETVLKLPSIPTLPARMAKLVPLEGLGCEAAVGSLTPSREREYKVTNKHTEGRRPVYAIVFNFLDVRYYDIFATACGPRLSTYRCLMNGKFALLQSYLDDDMNESFFTVSWACDIDGNPLLVAAGSTGIIRVINCATEKIYKSLVGHGGSVNEIKSQPSNPSLIISASKDESIKLWNVQTGILILVFGGVGGHRHEVLGVDFHTSDIYRFLSCGMDNTVRIWSMKEFWEYVEKSYSWTDATSKFPTKFVQFPVLCAEIHSNYVDCTKWLGDFVLSKSVENEILLWESITKEENPGEGHIDVLQKYPVPECNIWFMKFSCDFHHNQLAIGNRDGKVYVWKVQTSPPVLIARLNNPQVKSAIRQTAVSFDGSTILACTEDGNIWRWDVTSLKSFGSFNGNFGGKQTCDLASYIM

SEQ ID NO: 17362 - protein, 404 aa, Schizosaccharomyces pombe
MDHLEFDENTDSEYSIFEEDNDYGLHGLDDSVGFTDLFDAPNIYRVYSWLHKHYNQKKGQLKHGVSRQKNKLQPIHKQINYETDKLKERLGKSIDKFQEQWNSGKVVRFRDKLSFALGVSTCILTALLVGMAPESMHLWYTIQLFVYLPLRYYTYQRKGYEYFIADFCYWGNILLLVYIWIFPESRRLFILSYSISYGTLAWSVVAWRNSLLFHSIDKITSLFIHFFPPLVLHTIVHLTNKSYLKDRFPAVLKVKKIDLLSSVEIASFFYALWQIWYYFFIQVGKQKQIQEGRPTSFTWLSKASYSKTKLGRAVAKLPQNLQPFVFMIIQYLYSITTMLPCSLWYNNKLYSTAFLALIFGWSVWNGASYYIDVFGRRFQKELEALRQQLAETPTNSGSSSALSR

SEQ ID NO: 17363 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTKAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 17364 - protein, 807 aa, Neurospora crassa
MPGGSWRALGCRRYLLYLPKIPGPGRAVVNTSTSTSRCGRGLLQNSSISSKIPPPQPTPIANHLPSNIPLRTLSAHAAARDDPSTHSHGNRKQGSSSFLAPHPAERLRYSEDGDGDDSNDYGSSESSWIDTGDIAEQLDHEDPLRQRLYDTLEDDTLVGVVHHRHPKRHRHSGKHVHYHESVSSSSAHSSRPSGQAGVVDKEAIRIPDAAPRTVSRAERLIASIMAGTRNPIHGLTGKPLIYFTSIFVSLGVFLFGYDQGVMSGIITGPYFKDYFNQPTSAQIGTMVAILEIGALISSLLVGRIGDIIGRRKTILYGSCIFFVGGALQTMATDMAMMMTGRIIAGLGVGMLSTIVPVYQSEISPPHNRGKLACIEFSGNIIGYTTSVWVDYFCGFLEGNISWRLPLLMQCIMGALLGLGSLIIVESPRWLLDNDHDEEGIVVIANLYGGGDIHNPRARDEFREIKMGVLLARQEGERTYSEMFKRYSRRVFIAMSAQALAQLNGINVISYYAPLVFESAGWVGHDAVLMTGFNGITYLLSTIPPWYIVDRWGRRHILLTGAVAMVLSLSAISYFLYLDTHWTPSAVVVMVMIYNAAFGYSWGPIPWLYPPEILPLKIRSKGASLSTATNWAFNFLVGEMTPILQELIHWRLYLIHAFFCAVSFVIGEYLLTATPQGIQLTEFPVYFLYPETCGVRLEDMDALFGDSTNAFGTPTVSTPSLHAEVDPLVGPGSPVPRLDIRGRPLASAAIPGLPIDPPDEVEIINKSSSNQNRGGIGGLLSRLVGRRGRGSAEGSDSGSYAPLRQGDD

SEQ ID NO: 17365 - protein, 285 aa, Petunia x hybrida
MEQNQISHSLSNDESITDMGSGNYGCSHYRRRCKIRAPCCDEIFDCRHCHNDSKNSLEVDPHKRHDVPRHDIKRVICSLCNTEQDVQQTCVHCGVCMGKYYCSKCNFFDDDVSKDQYHCDKCGICRTGGNSNFFHCNRCECCYSNMMKESHICVERAMHHNCPVCFEYVFDTTKNITVLPCGHTMHLECVMQMEQHNQYSCPVCSRSYCDMSRVWEKLDQEVASTPMPEMYQNKMVWILCNDCGETSEVNFHIVARKCPNCKSYNTRQTRGGPSSCSSRIEEIVR

SEQ ID NO: 17366 - protein, 458 aa, Shigella flexneri 2a str. 2457T
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 17367 - protein, 122 aa, Triticum aestivum
GTTLMKAHHFIKASQIVDNPSGDFARKYRHISKGGWAFQVADQGWQVSDCTAEALKALLLLSKFPSDIVGDQMETCRFHDAVNVLLSLQNPNGGYGTWELARTYPWMENLNMTEIYADIMVE

SEQ ID NO: 17368 - protein, 135 aa, Solanum tuberosum
DFIAANQEARANNVIKGTKKEQVDQIVKDIREFKEKNKVDKIVVLWTANTERYSNVVVGLNDTMENLLAAVDRNEAEISPSTLHAIACILENVPFINGSPQNTFVPGLIDLAIKRNTLIGGDDFKSGQTKMKSGF

SEQ ID NO: 17369 - protein, 797 aa, Shigella flexneri 2a str. 301
MSQPIFNDKQFQEVLSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVMKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLTDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVCLAEFVKVRTGIEINPQAIFDIQIKRLHEYKRQHLNLLHILALYKEIRENLQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 17370 - protein, 181 aa, Vibrio parahaemolyticus RIMD 2210633
MTTETISLIKSSIKSIQDYPKPGILFRDVTSLLEDAKAYQATIGLLVERYKDMGFTKVVGTEARGFLFGAPLALELGVGFVPVRKPGKLPRPTIAQSYELEYGIDTLEIHTDAIVEGDKVLVVDDLLATGGTIEATTKLIRQLGGEVEHAAFVINLPEIGGDKRLEALGLNVFSICDFEGH

SEQ ID NO: 17371 - protein, 656 aa, Ralstonia metallidurans
MPGSPPGEPKSGRRGASRSTRPKSMTQSTTSHYYVESPSSRALVVGAIGVVFGDIGTSPLYSLKECFSPEHGIPFSPDAVLGIISMLFWAFVIVVSLKYVMFVMRADNNGEGGILALMALALRTAAPRSRMAKLIMMFGIFGACMFYGDAVITPAISVLSAVEGLEIAAPGLSHFVIPITLLILALLFFIQRSGTHVVGKLFGPIMVVWFLALGALGLIHLVQAPGIVKAINPVYAVSFLHDHSLQAFIVLGSVFLVLTGAEALYADMGHFGAKPIRTAWFVLVMPCLILNYFGQGAMLLGNPDAIENPFYLMVPSALQLPMVLLATAATVIASQAVISGAFSLTSQAIQLGFMPRMRIRYTSAAEIGQIYMPVINWILLVLVICVVLAFKKSDNLAAAYGIAVTTTMVITTFLAALVMRNVWKWNPALVTLISLTFLVVDMSFFAANLLKIAEGGWFPLLMGGSAFFLLMTWHSGRKLLRARSLEDGIPLEPFIAGLLAHPPHRVEGTAVFLTGNTESVPVSLLHNLKHNRVLHERVVFLQFVTRDIPYVDDDERLSCKDLGGGVYILKSEYGFKETPDVQRVLDLAQRKLGMQFELMETSFFIARESVIPSKLPGMSMWRESLFAWMHQNGAKPSDFFSIPANRVVELGTKVEI

SEQ ID NO: 17372 - protein, 174 aa, Hordeum vulgare
MAPTVMASSATSVAPFQGLKSTAGLPVSRRSNASSASVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCQESGKA

SEQ ID NO: 17373 - protein, 142 aa, Triticum aestivum
  unsure (1)..(142): unsure at all Xaa locations
MAATAVSVDEKLDKLRAEVAKLSQISENEKAGFISLXVSRYLSWGRRSKFEWEQXXDPRPDEVMGALTIPSTSPPXSXPKETKELAGQXLCAPTXXGGSXTTXGCTXPXSXIXIPHGXNSLTLMXIXIXPPGXKXGLPLETL

SEQ ID NO: 17374 - protein, 110 aa, Zea mays; identical to SEQ ID NO: 6810

SEQ ID NO: 17375 - protein, 364 aa, Buchnera aphidicola (Uroleucon sonchi)
MKKKYRIAVLPGDGIGPEVMREAYKILNILKYHFSLPLEIEEFDVGGSAIDKEGVALPKKTLLGCENADAILFGSVGGRKWDSLPIDQRPERASLLPLRKHFNLFANLRPAQLYSELKYLSPLAFLIVIKNGFNILCVRELTGGIYFGQPSGRSKTNNFEYAFDTEVYYDYEINRIAHLAFQLAQTRNYKVCSIDKSNVLNSSILWREIVKKVSLSYPNVHLSHLYIDNATMQIIKDPNQFDVLLCSNLFGDIISDECAIITGSIGMLPSASLNEKKFGLYEPAGGSAPDIEGKNIANPIAQILSVSMLVRYSMNLKNIADKIDYSVISILKKGYKTADIAHDNNYLKTNEMGDVIADALISGE

SEQ ID NO: 17376 - protein, 332 aa, Eremothecium gossypii
MFCRVARRGFRADGVRAYRVSVLGANGGIGQPLSLLLKLNKRVTDLRLYDLKGAKGVAADLSHIPTNSQVSGYTAENPEALREALTGADVVVVPAGVPRKPGMTRDDLFAINAGVVQQLAGAIGQHAPGAAVLVISNPVNSTVPIMAAELRKLGVYDPRKLFGVTTLDSIRASRFISEVQGTDPTRERVPVIGGHSGITIIPVLSQTQHTGIDKATRDALIHRIQFGGDEVVKAKNGAGSATLSMARAGAKFADAVLAGLAGEQGVVEPAFVDSPLYKSEGIEFFASAVTLGPRGVEEVHPVGTLSAEEEEMLAKCKETLKQNIEKGINFAK

SEQ ID NO: 17377 - protein, 328 aa, Glycine max
MGYVSMKVVLISTGVLSMAMGLKLTLPLLSHFLLNQAPHVWTFLLTCFTPPYLYILLNFIILTIVASSKLNNHHHSPPDTTVLLPSDPVIYALPPAAVQILAPETVNISAAVQTDYNAVASEKYLYETKPTLSYDTVTEGNGSVGYVYDENTPVKATVNNDDEAVGVVSPSLQRKDSSDFAFANENLKPPVSARFSHRKSVRASPEGGKVVALGVAKAKKQETLESTWRTITEGRAMPLTRHLKKAETWERETPLRDLNGGGKLMKKSETFAGREKNASTRLRKEPSLSQDELNRRVEAFINKFNADMRLQRQESLRQYKEMMNRGAH

SEQ ID NO: 17378 - protein, 328 aa, Glycine max
MCLPEGERGMALEAVVYPQPQDPFGHGIKDPSYNYNNLLEGGGGNWGYADFNLEKEDRTCVPFLANQTENYPYGEWNCSPSPPSMLPQLNIASNPQSSETSNTQNNLDSSVSTPARPKRRRTKSRKNKEEIENQRMTHIAVERNRRKQMNEYLSVLRSLMPESYVQRGDQASIIGGAINFVKELEQRLQFLGAQKEKEAKSDVLFSEFFSFPQYSTSASGGCDNSTAMSEQKSEAQSGIADIEVTMVESHANLKIRSKKRPKQLLKIASSLHGMRLTILHLNVTTTGEIVLYSLSVKVEEDCKLGSVDEIAAAVYQILDRIQQETISN

SEQ ID NO: 17379 - protein, 306 aa, Streptomyces globisporus
MRTRRRWSAADVPDRTGTTAVVTGASSGIGLHLAQELARHGAHVVLAVRDPDRGVAAAARIQSRVPSAQLTVRRLDLSRLASVRAGAEELRDRFPRIHLLVNNAGVMWTDRARTPDGHELQFATNHLGHFALTGLLLDSLRAAPGARVVTISSYLHRLGRIDFSDLHGERRYSRYRAYNQSKLANLMFALELHHRLAESGAELASLAAHPGLTATGLGRDFPAPVRRLGSPLAPLFLQPAAAGMLPGLRAATDPGARGGEFYGPLGVTETRGAPGLVRPGGAAVDPRARRRLWEESEHLTGVRLRP

SEQ ID NO: 17380 - protein, 101 aa, Glycine max
  unsure (1)..(101): unsure at all Xaa locations
MRTKRKEMASSMISXPADTSGNRASSGLDARFAVLKSMAGFPTSETNKDITLIAXNCGRVLCMQVXSPIVMMKFXTLCYLPDLDDAQLAXEVRYLLKNGWI

SEQ ID NO: 17381 - protein, 374 aa, Oryza sativa (japonica cultivar-group)
MKVIEKIQEAAADGRTVFSFEYFPPKTEEGLDNLFERMDRMVAHGPNFCDITWGAGGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPEAHPDAIQSTEGATPEAYSNDLAYLKQKVDAGADLIITQLFYDTDIFLKFVNDCRQIGITCPIVPGIMPINNYKGFLRMTGFCKTKIPAEITAALEPIKDNEEAVKAYGIHLGTEMCKKILATGIKTLHLYTLNMEKSALGILMNLGLIEESKISRSLPWRPPTNVFRVKEDVRPIFWANRPKSYISRTLGWDQYPHGRWGDSRNPSYGALTDYQFTRPR

SEQ ID NO: 17382 - protein, 798 aa, Streptococcus mutans UA159
MQLTKEKFIRDFKDTLHEEQLIKIPEATPTELFASLAKVVRKYYTPLWLERNRKISQNQQKVAYYFSIEFLPGRMLETNLLNLGILDTVKEGFAELGVNFEDVKNAEHDMALGNGGLGRLAAAFMDSLATTGYPGFGNGLRYKYGLFKQRIVDGYQVELPDSWFGSVGNVWETRKDHDAVEVKLFGNVYLQANERGRIVPVYDGAQILRAIPYDVPQIGFGNDNINNLRLWDVEIPEECELNYPTLESRRRVKNITAILYPDDSNYEGKELRLIQEYFMTSAGLQTIIKSYLKQGLPLERIHEKISVHINDTHPAVAPAEFMRLLIDEYDLEWDQAWETTVQTMSYTNHTILSEALEKWDAGLFKNVLPRVYQIILEIDNRFVAGLAQKGIDPQIIENTRIVKDNQIHMANLAIIGGHSVNGVAKLHTELLKEDTLHDFYTLYPGKFNNKTNGIVQRRWTQIAAPELSAALDQTIGNSWRTDIHELRKLNDFANDSAVLDHFYQVKQDAKAKLAAYIKESTGVEVSTDAIFDVQVKRLHAYKRQLLNVLHIVKLYWDLKDNPNLDMVPRVFIFGAKAAPGYHFAKSVIKIINELANLINSDESLQGKLKVVFLENYNVSLAELIIPAANVSEQISLASKEASGTSNMKFMMTGAVTLATLDGANIEIKDEVGDENIVIFGMTKDDVYRHYENHDYYSRGVYESNPVIKRVVDTFINGTIPNSQSEGTEIYEALITHNDEYFLLEDFIAYVQAQEKIDALYRDKETWSRMSLCNIANSDKFTSDDTITQYAKEIWHLEI

SEQ ID NO: 17383 - protein, 605 aa, Oryza sativa
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEHAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 17384 - protein, 499 aa, Hordeum vulgare subsp. vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 17385 - protein, 145 aa, Zea mays
MDSGSRSSGGAGFDDEDGLTTRREVSSSLQDLAVRVDRKGGSCSDGGTNQGPNTPRSKHSATEQRRRSKINDRFQILRELLPHNDQKRDKATFLLEVIEYIRFLQEKAQKYEATFPEWNQENPTMLPWSKGQIPGDSPPDPLHCM

SEQ ID NO: 17386 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKSKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 17387 - protein, 393 aa, Solanum tuberosum
YAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 17388 - protein, 383 aa, Glycine max
MGNNRFKLSDMIPNAWFYKLKDMSKSRKRNGSHAMKSKVSSPPTTTTSQRSLPRYSHYFSTEPIRAGKLYNTPIHTKDLDMPFTDSPRRSSKRRARRKTIYKPSPTVVSSSFIPSSGYDSANHWIKPCQVQSPDYDVSSAESSSESDLHEYAYSESECDSFSVPDLLNGMDTNCSCRVSSSTNDIIIDMNSESFLGNPEKQDGFDAISQLGLAPILTRPVKFDDKVIEAAEVRSSTDLDEMQDDQSFSIEINKEESIRTQRRRKSNHRKPFANSAGIRLRVNSPKLASRKVQACARRSVSSTASKGSRSTGFPDGFAVVKSSFDPQSDLRESMVEMIVENNIRASKDLEDLLACYLSLNSSEYHDLIVKAFEQIWFDLAQLRM

SEQ ID NO: 17389 - protein, 359 aa, Staphylococcus carnosus
MSEKVKFEKREDLKQKPDPKNLGFGQYFTDYMLSYDYDSEKGGWHDLKITPYAPIELDPAAQGLHYGQLVFEGLKAYKHNGEVVLFRPDQNFARINQSLDRLEMPQIDEEELLEGLKQLVDVERDWVPEGEGQSLYIRPFVFATEAGLGVHPAHNYKLLIILSPSGSYYGGDSLKPTRIYVEDEYVRAVRGGVGFAKVAGNYAASLLSQSNANEQGYDQVLWLDGVERKYIEEVGSMNIFFVENGKLVTPKLNGSILPGITRKTVIALAKELGYEVEERHISIDELLESYDKGELEEVFGTGTAAVISPVGTLKYEDREITINNNETGPITQRLYDEYTGIQSGKLDDPQGWRVVVPEY

SEQ ID NO: 17390 - protein, 378 aa, Vibrio cholerae
MKRLFAWGAPLFALVALTLSLFSQADTKPSTIDSTSANYQQATLAGGCFWCTESDMEKLPGVVDVISGYAGGDVDNPTYKQVSSGKTGHIEVIQVTFDPKIVTYEQVLDNFFRHIDPTDDQGSFVDRGEQYRPAIFYHNAEQLEVAKRFMMEIDQLGIFKKPLKTELIEFKKFWPAEDYHQDYYKKNKVRYNYYRYASGRDQYLDEIFGADRNTHPKTLRQWIDEKNGQANVKAYVRPSDEQIRAKLTSLQYKVTQRDGTERPFDNEYWDNKEEGIYVDIVSGEPLFSSTDKYDSKTGWPSFTQPLNSSYIVTKDDNSLFYTRTEVRSRFADSHLGHVFNDGPAPTGLRYCMNSAAMRFIPKQEMAAQGYGEYLALFK

SEQ ID NO: 17391 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPAYAGQDKVNPGSIILSAEMMLRHMGWTEAADLIVKGMEGAINAKTVTYDFERLMDGAKLLKCSEFGDAIIENM

SEQ ID NO: 17392 - protein, 321 aa, Nostoc punctiforme
MSFFYTPASAMKLDTLPPIRETRKLTPISDDDLAIILMIRHFELSLLELFSSGKLNGTTHTCLGQEYIPVALKAVLTDSDFILSNHRGHGHYLARFEDPEGLLAEIMGKEGAVCHGVGGSQHIYRKNYLSTGIQGESLPVAAGIALHLRRQGNFGMAVVHIGDGTWGEGGVYEALNIAQLWGLPVLVIVENNKIAQSTPTQLQMAGTIAGRVQGFGINYLKVDSIDINEIRTLISSHIQSARTKSLPLVIEFDTNRVGPHSKGDDTRDIQELERIQKWDWYSVYQQQYSDQFERIELKVKTEISSLIRDVESRELVQWKLL

SEQ ID NO: 17393 - protein, 74 aa, Zea mays
ELPSSDSLMSAAIYLNHSVPLVSVAYGMHGSYIGVKGEAIYIPPPQCVTVDTCGAARRIRLLGLLCQASCRGAS

SEQ ID NO: 17394 - protein, 453 aa, Agrobacterium tumefaciens str. C58
MTIMNTSQDITVAAGGLDATAAIQQAIDAVSSAGGGRVSLSAGRHVSAGLHLKSGVELHLAEDAVLAPVSDYDAYALTRVSVIAEDSDRGMIIANGASNIAVTGPGRIEAGGENFIIGDDAAMGTYVPAKKRPRVMVLEACRNVRLENLNVSASPMWTLHMVNCEDLHFRNLRIENDRRLPNTDGIVLDACRRALIEDCFISTADDGICLKTSAGPDGKAVGVCADITVRGCTVSSMSCALKLGTESFGDFTNVVFEDCKVVQSNRGIGLFSRDGGAMRNIRFSRIETECHETPGGFWGSGEAVTVTVVDRRPERQAGRVENLVVEDLGGSMEGAINLVSTSKAGIHNVRLERITLAQQPGKLGTGLQYDLRPTNADIAPSAEAAGRANAWTQDAEGRIVGMEDYPGGMPAIYLSGVHRFSADNVAIKRAMPLPEGWNIKEIVATTGSDEGSM

SEQ ID NO: 17395 - protein, 81 aa, Triticum aestivum
MGNPEKMMDEIFNLQLTPNSLQGHARTREKEEKEQKLKGKKALATPPVDGARIYVENAFRLRTDPMNSLRLPSRLHAAVSR

SEQ ID NO: 17396 - protein, 423 aa, Azotobacter vinelandii
MLDLAAAFIALTTLFTYLNYRLIRLPPAIGVMIGALLLSLLAYGLSALGYPVLELEIQEMIRRIDFSDILMTWFLPALLFAGALHVNLDDLRSYKWPITFLATGGVLIATFVVAGLAHYTFALFGWQVSFIYCLLFGALISPTDPIAVMGILKSSGAPKPLQTTIVGESLFNDGTAVVMFSILLGVLMIGHTPTIGEVSLLFLKEAIGGIVFGLLLGYVVYLLLSKVNEFQPSVMLTLALVFGGASLAAKLHVSAPIVMVVAGLIIGNHGRHHAMSEESRRYVDGFWVLIDEILNALLFALIGLELLVLPFTWLHVVAAILLGGAVLLARVLTVGPGIILIRQLKSVQLQVAPGTVRILSWGGLRGGVSVALALALPLGPERDLLLTLTYIVVLVSILVQGLTIGPLVKSLYGSNPVEAEEAH

SEQ ID NO: 17397 - protein, 469 aa, Sarcomenia delesserioides
VIPYAKMGYWDPEYVIKETDVLALFRVTPQPGVDPVEASAAVAGESSTATWTVVWTDLLTACDLYRAKAYKVDKVPNSTEQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQTMGIWARKNDMILHLHRAGNSTYSRQKSHGMNFRVICKWMRMAGVDHIHAGTVVGKLEGYPLMIRGFYNTLLLSHLDINLPQGIFFQQDWASLRKVTPVASGGIHCGQMHQLVDYLGNDVVLQFGGGTIGHPDGIQAGATANRVALESMIMARNEGRDYVAEGPQILRDAAKTCGPLQTALDLWKDITFNYTSTDTADFVETATANV

SEQ ID NO: 17398 - protein, 496 aa, Methanosarcina barkeri
MSEQRSVPLRKHLLDLKPCRHGGLVQETSETYGIPESEIIDFSANFNPLGNPFEHPESGLNFDEILNTGFKKLTEYPDNRYPEFREAAAKFVGLGVGPKNIIPGNGSTEIIRLVVECVVEKGDTVLLPWPTFGEYEMQCRIMGAELQYPSQDEVETLPDELLEKAKILFICNPNNPTGKLRTRKEIKALAERCTQHKTLLFVDEAFIELSDPSQSVADLTVNNNYVFVMRSLTKDFAIPGIRMGFGIASPEVAEILDTARLSWNLGTVADAVATSLLNIEGGIENPYLKKARDMIREEGEVFKAKLDSIRGFKAGEVNVNFILVDISKFMLDSTELTARMAARGVLIRDCFSLHGLGKDYIRLAVRTAEENDRLITAVGDVITEWGREQAKQELKNVIEKASEEGIGGRKTCEYYPCHFKGQNCTFCFCPFYPCEDERTGGKWIQSSRGGKIWSCVDCHLVHKTETAQKILDCLMQEGDTDELVKVAWKKVMEPIL

SEQ ID NO: 17399 - protein, 352 aa, Xylella fastidiosa Dixon
MNVMGFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDIIIDTVPYDHDVNPYMPTLVLEGVLVLVGYLGPLSMPVNAGGVVRGRRAISGSFIGGVPETQQMLDFCGQHGIVSDVEIIPIQKINEAYERMLKSDVKYRFVIDMTSLTSSGA

SEQ ID NO: 17400 - protein, 275 aa, Gossypium hirsutum
MATASTWILSLKVFLISTGILGIVLGLKISVPLVLEFSVSQAPLWWSGFRSWLKPPYLYVVINGIIITIAASSRFNQNNGEKDQMEQMQPRPKISADQQPMVEYETKSGWDSDAVESSDFVYEENQRGEEVETRVSEEESNVAVEDDRDGNEFVISKSEWIPPSRTDSSEIPLDALLIQEKPAPSSRFGHRKPVKVNPEGGRALKVAKPKRHETLENTWKMITEGKSMPLSRHLKKSDTWENHGRDINVEALTSSPLMKKSETFRDRTNYQLPPE

SEQ ID NO: 17401 - protein, 236 aa, Haemophilus somnus 2336
MSKLSLIQQLKQQKLSVGILSANWLQLNEEVTTLLEKQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWIVSGSALFSGELKTNLKVWKSSIM

SEQ ID NO: 17402 - protein, 604 aa, Zea mays
  unsure (1)..(604): unsure at all Xaa locations
TRPIADRCDKKGVSVDERLIRVAEMLEKMVESYSPKDLPNAAVSPDVAKVSSSSINEESDGPSPKLSDWSRRGSADMLDYLQETDNTISLDDIKNLPSMTCKTRFGPKSDHGMATSSAGSMTPRSPLTPRSNHIDMLLAGKNAINESGDLPQIVELADIARCIANTPLDEESALSQMVTCIEDLQEIVNRRKHEALTVQTFGTRIEKLHREKYLQLCDSVDMDKVDSASTIMDEEDDVVRSLRASPVHPVKDRTSIDDFEIMKPISRGAFGRVFLAKKRTTGDLFATSRPAGKVLRKADMIRKNAVESILAERDILITVRNPFVVRFFYSFTSRENLYLVMEYLNGGDLYSLLRNLGCLDEDVARVYLAEVVLALEYLHSMHIVHRDLKPDNLLIAHDGHIKLTDFGLSKVGLINSTDLSGPAVSGASLYGDDEPQMNELEQMDHRARRQNRSAVGTPDYLAPEILLGTGHGCSADWWSVGVILFELIVGIPPFNAEHPEAIFENIMNRKIPWPHVPEEMSFDAQDLIDRLLTEDPHQRLGANGASEXDDMGEDSTGLNEFESSANVNYSFSNFSFKNLSQLASINYDLLTKGLKDDPPPRTEM

SEQ ID NO: 17403 - protein, 519 aa, Enterococcus faecalis V583
MNNDVHEIKQLDGTRIGFILKGIVVGILVGFVVSLFRLGIEKIGEQVVHLYQTFHEKTFWMIPWFLFSLVLAYLLGRLIKSEPAIKGSGIPQVEGQLQGQLEIHWFPVLWKKFIGGILAISPGLFLGREGPSIQLGAVVGQGYSQWRQSTKSEEKILISSGASAGLAAAFNAPIAGLLFVLEEVHHSFSPLVWLTSFSAAISANFVSLHFFGLQPVLYIGPVKSLPLEYYWTLVLLGVLLGLLGWIYQKTLLSLPKVYGKIKGLSSNYYGFVSFILILPIGYFFPHLLGGGNQIVLALGNQPTTIWALVGLLVLRFVFSMVSYGSNLPGGIFLPILTLGAIIGTLYGSLLVQYVGMDPIFVKNFLIFAMAGYFTAIGKAPLTAIILVTEMVGNFSHLMSLGVVALVSYITIDSLGGKPIYESLLERLVPSKVSNIRGHKTIIELPITAESSLDDTMVRDFVWPKQMLLTSIRRGESEILTHGDTVMHVGDVLIILTDEKLAYQVKKEIYQKTLPNDLVN

SEQ ID NO: 17404 - protein, 81 aa, Zea mays
ITMDRSIFHGSSGHHTTVTTTNAGAPVWNDNEALTVGPRGPILLEDYHLIEKVAHFAREHIPERLVHAHSAFTKDYFKCTH

SEQ ID NO: 17405 - protein, 474 aa, Tropheryma whipplei TW08/27
MFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 17406 - protein, 146 aa, Oryza sativa
MFVEGFRVESPRVRYGDGEIESEYRYDTTEVVAPPSPEKGWVVRPKSVTYHFKTTTTVPKLGVMLVGWGGNNGTTLTAGVIANREGISWATKEKVHKANYFGSLTQSSTIRVGSYNGEEIYAPFKSLVPMVTPSSQFFSSYSIFTH

SEQ ID NO: 17407 - protein, 224 aa, Neurospora crassa
MGKEHQLTPNTRDGHFVPNLTWGPPIVAKIRGHVEKPTEAYGKGTFDCHMMIAEPKKWVKEFKKAGCDLYCFHYEAAFSTAAESPEAKSDKKTSPKELIKYIHDQGMLAGIALKPATSVDVLWEILESEDPKERPDMVLIMTVEPGFGGQKFMASELPKVQELRKRYPELNIEVDGGLGPSTIDQAADAGANVIVAGSAVFGAQDPSEVIALLREAVEKRNGKL

SEQ ID NO: 17408 - protein, 361 aa, Glycine max
IRLEDGMTMQGIGTQSWDVGFIVQALLATNLIDDFGPTIAKAHDFIKKSQVRENPSGDFKSMYRHICKGSWTLADRDHAWQVSDTTAECLKCCLLLSVLPQDIVGEKMELEKLHDSINLILSLQSKNGGMTAWEPAGAYKWLELLNPTEFFADIVVEHEYLECTASAIQVLVLFKKLYPEHRKEEIENFIAKAVTFIEDTQLENGSWYGNWAVCFTYSSWFALGGLVAAGKTYTNCVTIRKAVKFLLKIQNKDGGWGESYLSCPRKMYVPLEGSRSNVVQTSWALMALIHAEQAERDPTPLHHAAKLLINSQLEDGDWPQQETLGVYLRNCLVHYSFYRNIFPMWALAEYRTNVLLPSFTI

SEQ ID NO: 17409 - protein, 118 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 17410 - protein, 387 aa, Oryza sativa (japonica cultivar-group); identical to SEQ ID NO: 17311

SEQ ID NO: 17411 - protein, 313 aa, Eucalyptus globulus
ANLFAMQLATASVLPAVLTAAIELDLLEIMARAGPGAYLTPGEVASQLPTQNPDAPVMLDRIFRLLASYSVLTCTLCDLPEGKVERLYGLAPLCKFLVKNEDGVSLAPLRLIDQDRVFLESWYYMKDAILEGGIPFHKAHGMTAFDYPGTDPRFNKIFNRAMSDHSTIMMKKILETYNGFEGLKTVVDVGGGTGAILNMIVAKYPSIKGINFDLPHVIEDAPSYPGVEHVGGDMFVNIPNGDAVFMKWICHDWSDEHCAKLLKNCYDALPVNGRVIVAEYILPAYPDQSLSTKGVIHMDCIMLTHFSGGKERT

SEQ ID NO: 17412 - protein, 366 aa, Triticum aestivum
MDTHIGSVDGPSPAAVNGAVGCPASAPGCPIMSSHPVVSAGEASLGRHLARRLVQVGVSDVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVM

SEQ ID NO: 17413 - protein, 102 aa, Medicago truncatula
MAHSQGKALAQWMIGALLFAMLAGSLAVQICNIDPNDLKQSCSKFVTGRNPPRADEACCGVLRRANLPCLCGYKSALTYYGINAKKALALPGQCGLQTPSNC

SEQ ID NO: 17414 - protein, 316 aa, Vibrio parahaemolyticus RIMD 2210633
MSNKLEQLRKLTTVVADTGEIDAIKKYQPEDATTNPSLILKAAQIAEYAPLIDASIEYAKAQSNDKAQQVQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEASEDPGVLSVTKIYNYYKEYGYKTVVMGASFRNIGEILELAGCDRLTIAPALLAELEAAEGEVVEKLVDSKGAAERPAPMTHAEFLWEHNQDPMAVEKLAEGIRNFAVDQGKLEAMIEAKL

SEQ ID NO: 17415 - protein, 259 aa, Streptomyces coelicolor A3(2)
MPAPAPSPVLLGVSLKMYFGHHQTLNWSRRIAALAERHPAVTSGAARLFVLPTFPALVPATGILAPYGVALGAQDIATEDSGPYTGEVGGPVLKEIGCRYAEVGHAERRRLYGEGDTVVAAKTAAALRNGLTPVLCVGERDAADPADAASRTVAEAERLLGGLSGAVVLAYEPQWAIGAPEPASADHIATVCTALRGWLDSHPRHAGSTVIYGGSAGPGLLTRLAGTAEGLFLGRFAHDPANVGAILDEIRSPAPAAVA

SEQ ID NO: 17416 - protein, 158 aa, Salmonella typhimurium LT2
MKLISNDLRDGDKLPHRHVFNGMGYDGDNISPHLAWDNVPMGTKSFVVTCYDPDAPTGSGWWHWVVVNLPADTRVLTQGFGSGLVAVPDGVIQTRTDFGKAGYGGAAPPKGETHRYIFTVHALDVERLDVDEDASGAMVGFNVHFHSLASASITAMFS

SEQ ID NO: 17417 - protein, 566 aa, Schizosaccharomyces pombe
PNGNAFYSFEYFPPKTTVGLENLSSRITRMSRNMMPLFSSVTWGTAGSTAEVSIYLAKMLEQHHKIPACLHLTCTNVDKAIIDKALETAKEYGIRNILALRGDPPLNSDHWEGKVSEFEHAVDLVRYIREKYGDYFCIGVAAYPEGHVDSNVPELSKDPLRDIPFLIEKVEAGADFIITQIFYEPEAFIKFDNFVRNHSSNALRNIPIIPAIMPIQSYGSLKRMTRLCGCSVPSSLMQRLNAAKPDDEAIKNIGVEHIVDMIKKIMDNVQARVHGFHFCTLNLERSVALILKNSGLLTKRWKQVESEMEDEKLLRTTRKRLSLDEPAELHNQVVVPSQQPVADKSSNLFVTSKQSSVSGHKDNLTEEAPFSVSEGSGVLGRQANWDDFTNGRFGDPRSPAYGEIDGYGPTLHFPPSEALKLWGYPVDESDITSLFQKHIMSDISVIPWIDEPVEVETKTIAKYLLKLNGNSWWTVGSQPAVNGAPSADPVFGWGPKGGRVFQKAFVECFVNGKDLKDFITKWHDNPHVRSNFSSSISDSTCFQRLVSKPLFLRIRATDRSKFSVQK

SEQ ID NO: 17418 - protein, 150 aa, Yersinia intermedia
NESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHH

SEQ ID NO: 17419 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIETVVAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 17420 - protein, 337 aa, Methanocaldococcus jannaschii
MVISMHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 17421 - protein, 746 aa, Oryza sativa (japonica cultivar-group); identical to SEQ ID NO: 1134

SEQ ID NO: 17422 - protein, 236 aa, Glycine max
MRVVCCSNSGVSAFPSCLRFPPLIAISTTPSSIRFLNSPPLRSTASSQHVTIMASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 17423 - protein, 237 aa, Oryza sativa
ENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 17424 - protein, 440 aa, Cladosporium herbarum
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 17425 - protein, 754 aa, Streptococcus pyogenes MGAS8232
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSIASLGINGEGVGLNYHCGLFKQVFKHNEQEAEPNYWIEDQSWLVPTNISYDVPFKNFTLKSRLDRIDVLGYKRDTKNYLNLFDIEDVDYGLIKDGISFDKTEIATNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWMTKVVHNIAKAGFFSSDRTIEQYNEDIWHSR

SEQ ID NO: 17426 - protein, 477 aa, Asterocladon lobatum
MPENVQERTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPFLGATVKPKLGLSGKNYGRVVYEGLTGGLDFLKDDENINSQPFMRWKERFLYCMEGVNRAAAATGEVKGSYLNITAATIEQMYERAEYAYSIGSVIVMIDLVIGYTAIQTMAIWARKAEVILHLHRAGNSTYARQKNHGINFRVICKWMRMCGVDHIHAGTVVGKLEGDPLMVRGFYNTLLLTHLKVNLAEGLFFDMDWASLRKCVPVASGGIHCGQMHQLLYYLGDDVVLQFGGGTIGHPDGIQSGATANRVALESMVLARNEGRDYVGEGPEILRHAAATCGPLKAALDLWKDITFDYTSTDT

SEQ ID NO: 17427 - protein, 547 aa, Cochliobolus heterostrophus
MQSSNEGPADIIAKVAGVTQGGKREDDGPYFTNNEGIPWPDAEHSKTIGGIPVASDVFLFQKQQTFNRSKNLERMVHPCGSGAFGYFETTKDVTHLTKADFLKTVGEKTPIFIRFSTVTPGREYPDEARNPRGFAIKFYTGEGNYDIVGLNFPVFFCRDPIQGPDVIRSQWRNPKNFLFDYDAIFDLLANTPEGNHAGLMFFSDHGTPQGWRFNHGYGCHTFKWVNKDGQFVYIKYHFVAEHGQKQFTQEQATQMCGEDPDYSKRDLYETIENGEEVVWKAHVQVMSPEEADPDKLGFDPFDVTKVWPRKQFPMQEFGRLVLNKNPENFHRDVEQAAFSPGSMVPGVEDSPDPLLQFRMFFYRDAQYHRIGVNLHQIPVNCPFMAKSFASLNFDGQMRVDANHAGNKPYAPNSFAHKFRPDVAEAPYQVNDNIMSRKSHYWHEGKKNEYDQAKELWSRVMSVQEKQNTIKNTANMLKFVRYPEIQQYNIGTDLSRGIYDLLPKPAFDFSEVEELSHTAHEWYKEKKFRSIDGERLTGFPPSMPVYNY

SEQ ID NO: 17428 - protein, 534 aa, Arabidopsis thaliana
MPIKVLSSLDVARTQWYHFKAIIVAGMGLFTDAYDLFCIAPVMKMISHVYYNGDSINTAVLSTSYAIALLGTATGQLVFGYLGDRVGRRRVYGLCLIIMILSSFGCGFSVCTTRRSCVMVSLGFFRFFLGLGIGGDYPLSATIMSEFANKRTRGAFIAAVFSMQGLGILVSSAVTMAVCVAFKRSGGGLEVDAAAPTEADLAWRLILMIGALPAALTFYWRMLMPETARYTALVENNIVQAAKDMQRVMSRSHISDEATTDPPPPPPPPSYKLFSRCFFRLHGRDLFAASFNWFLVDIVFYTSNLLLSHIFSHYSKKPSTAENVYDAAFEVAELGAIIAACSTIPGYWFTVYFIDKIGRVKIQIMGFFFMAVIYLVAGIPYSWYWSKHEHNNKGFMVLYGLVFFFCNFGPNTTTFIIPAEHFPARFRSTCHGISGAAGKLGAIVGTVGFLWATKKMESDDKNQIYPEVNRMRIAFLILGGVCIAGILVTYFFTKETMGRSLEENEHDQDNNAESEDEPQIVDGQSSVSTLLQTR

SEQ ID NO: 17429 - protein, 208 aa, Cicer arietinum
EVSARDLTEISSNTEKDVAEKKNEVTDANYDGFNGGGNYGNGGGYPSNGGGNYGHGGGNYGNGGGNYGHGGNGGGNYGNGGGNYGHGGGNYGHGSNGGGNYGNGGGNYGHGGGNYGHGGNGGGNYGNGGGSYGNGGGNYGHGGGNYGNGGGNYGHGGGNYGHGGGYPGNGGHGGGYPGNGGHGGGHGGHGGGYVGEATDVQREDKTLN

SEQ ID NO: 17430 - protein, 84 aa, Glycine max
MKVKILQWHAIASWTWDAQDETCGICRMAFDGCCPDCKLPGDDCPLIWGVCNHAFHLHCILKWVHSQTSQAHCPMCRREWQFKG

SEQ ID NO: 17431 - protein, 670 aa, Penicillium janthinellum
AAAQRRQNDSSVFLAIMVAAAVESESSLTDGDAGALLLQDISEWDEVFRFDRLEAVERAAHAAAAAAFGAFVARGDWTASAAAAFQAAGKQIAFMAAFSTVAGAKGSATVRDADAFAAKFASAAALQELVGNNSPISFFIFDLLFAAILFASKAKAANQAAFAAAAELAAESLFVRLPSLHQVSFFALAGFAAVAAHRHMNGYGSHTFKLVAKDGSVYCSKFWYKADQGQAAEVWKDAEEVAAEDVDYFRDLNFQAEAAGRYPLWELASQVMTFSDFEIDPFNENIPTKVVPRESVPLIVDAELLLNRNPLNMFAEVEQVFMDVAAASKGADEVEDPLIQRQFAYIDTHLSELTASYGIPVCRPYATVLNDQEDGARYDDVQDVLVIAPNAFSASAVEVQIPAAAAFNLAAARVAAAGDVRVNAVVEADQRKQSRQFWASDVNAQKKRLVDAFRMEVASAVSASIQVDVTVEFSFVAAAAAARIAAAVGSAAAGALANRRQIKVIASLAVLAKADAKVRQKNALESSSQAVAVDAKAAAQDIVDSSDAANVVTVAREFAVLPQTAAADAAEFVAAASAKAFSSFPAMEVISVAAAAGAVAEPARASLDLNMAMFFSRIVASRGAAANAIAALVKASRDGVFVAAVLAKAAANNRAAEAIFKFEVRQAVDA

SEQ ID NO: 17432 - protein, 564 aa, Mesembryanthemum crystallinum
MRERGMDSARSWLHKYQPRDKLRSSTKKKDSMMGGRDDSAPTSDEETPSNVTKQRVAAAKQYIEKHYKEQMKSLQERKERRSILERKLHDADVSEEDQNNLLKFLEKKETEYMRLQRHKMGADDFELLTMIGKGAFGEVRVCREKTTGHVYAMKKLKKSEMLRRGQVEHVKAERNLLAEVDSNCIVKLYCSFQDEEYLYLIMEYLPGGDMMTLLMRKDTLTEDEARFYVAETILAIESIHKHNYIHRDIKPDNLLLDKFGHLRLSDFGLCKPLDCSTLEEKDFEVNNGNGGSPSNEGSTKPRRTQQEQLQHWQKNRRMLAYSTVGTPDYIAPEVLLKKGYGMECDWWSLGAIMYEMLVGYPPFYSDDPMSTCRKIVNWRTHLKFPEEAKLSPEAKDLISKLLCNVTQRLGSNGAHEIKLHPWFNGIDWERIYQMEAAFIPEVNDELDTQNFEKFEEADNSSQSTSKAGPWRKMLSSKDLNFVGYTYKNFEIVNDYQVPGIAELKKKDTKPKRPSIKSLFEDESSDSSEAATSGDQSVQGSFLNLLPPQLEVSQTQTEVPPPKFT

SEQ ID NO: 17433 - protein, 486 aa, Saccharomyces cerevisiae
MVHLGPKKPQARKGSMADVPKELMQQIENFEKNFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVSTRYPGFKEKAANALKDIYGWTQPHLDDYPIKVVPAEDGSGPGAAVIAALAQKRIAEGKSVGIIGA

SEQ ID NO: 17434 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRPIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKADDYDPVNRNIGKFILEYAYCCHQFIHLPPSTVSAMAMYIARRMTNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 17435 - protein, 1423 aa, Eremothecium gossypii
MAFLKRLNVSSHSRSSSGSSGRTPQNTSGGSKATAVKPLPQIPVEMGGIESEVIKNGEGGQSVVILCDDVGSGSYTSVLLSPSDPHMFSADGQRLSVEEQAEKTLYSWDVTDPEQWTMQRVMSWFKAHDFDEQWILFFKRNHISGKKFLQLLAHDNFNKYESFLSATKNSSYNRFQHLLKRTLEENVSNSHRRQRSNKSNDSKGSADCSLRYRRRRSVASEQRTLTAAEGVTPRKTVEVADDRAGSSKNHRKAKSASVLYRRSFISLRSSSSSNIKNDVDDDCKTLPAMKISIPPRPFSSIERSTSSSPASTLKSQSSPLSPGNHNMFRKDHKSSSSDSSLFNNLFGSADEITKAVGGTAPQGEQIAVKKYNDTLPSPMRVSPRHIDDKSTIWDKLKKRALPSTEQYTPSRIKQLTSGRNSSYIQTLQESPDECSANNEDPPATATLEAPIIDDLVLEEKHYPSQKQDSSAQYVLVTKDNRIFLPLNIAPYKTTQELKDGMTAFLGISSKAYTIHLTDLGCDPGVSLSDDVIAAIGQRKLNTRHLKFYVKDATRMHLRLKNDSFTSDHNITTEMSRSKGSLRSAASSFISSNDDTNSFSDITSIDEHGNITGRRVYPQTPSHYYDQSAATHSPEVDYWNIKERLSEGTSPMNISLLRSTTKAASLPSSIDEIKKSSFKVIRKASVTDIDFNKGRESPYIRPKLAPKREAPRPPRTSSQVSLASSSSIQSSLVEQKSISNSPTKPQRQHAGTYVKNKTRPPPPPSIGSTMTVDTKVMTSVSDSPVSNEPPNRPYGPFSTQKLVPQGFKGVGVHPGTRKVEEQMHTNPVTQYIQKQRSRNSISKMGNNPSLYSPPRLKKRISTRRMVSSTSAADIFDENEISFADAPDLSDYDSENSESSDDIIWSTTNTTSLDASKISVSDSTTGDDSNFSVASSVELQSSIKNDAKTSEDSIVDSIKEEGDSVCNLVGRKMTLRPTTEVVYQNLEMFFPGTDLDKPILEGLTPPASPDSEANKMPDQDLTPLSKVSTISSESSMRQSTPRLLITKKSDSPQPMPVRNLKPPKRTKTIRSIAREASEARKKSLYNNLKRQNTKMWGTRVVEVTDKRMVSINKSKNSKGEYREFAWIKGEMIGKGSFGAVYLGLNVTTGEMMAVKQVEVPKFGSQDETTVNNAEALISEVSTLKDLDHLNIVQYLGFENKNCIYSLFLEYVAGGSVGSLIRLYGHFDEQLIRFLTTQVLEGLAYLHLRGILHRDMKADNLLLDNDGVCKISDFGISRKSNNIYSNSEMTMRGTVFWMAPEMVDTTQGYSAKVDIWSLGCVVLEMFAGKRPWSNLEVVAAMFQIGKSKSAPPIPEDTLPHISQDGRAFLDDCFMIDPEERPTADTLLSHPFCQVPKEFNFRDTDLYNFIKQNDKLNNSKLTRNSQR

SEQ ID NO: 17436 - protein, 170 aa, Helicobacter pylori
GSGMHTHVSVWKNNENLFSGETYKGLSGFALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 17437 - protein, 119 aa, Triticum aestivum
KRLTSSTSGEETGGPCGTSCSPVAGKGHFVVYTTDGARFEVPLAFLGTTVFNELLRMSQEEFGFTGVDGGRITLPCDASMMEYAMCLLRRNASSRDGRPHSSNTMVMPCHYHAELHLRS

SEQ ID NO: 17438 - protein, 82 aa, Zea mays
  unsure (1)..(82): unsure at all Xaa locations
VRVALAHMLRCGVIMDVVTPEHARLAEEAGXCAVMALDRFPAYIRAQGGVARMSDPGLIRDIKRAVTILVMANARIGHFVEA

SEQ ID NO: 17439 - protein, 469 aa, Pterocladiella capillacea
  unsure (1)..(469): unsure at all Xaa locations
VXPXAXMGYWDPDYXVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGXNYGRVVYXGLKGGLDFLKDDENINSQPFMRWKERFLYSMEGVNRSIASSGEIKGHYMNVTAATMEDMYXRAEFAKQLGTVIVMIDLVIGYXAXQTMAXWARRNDMXLHLHRAGNSTYSRQKSHGMNFRVICKWMRMAGVDHXHXGTVVGKLEGDPLMIKGFYNTLLLTHLDTNLPQGIFFEQDWASLRKVTPVASGGIHCGQMHQLLDYLGLDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 17440 - protein, 170 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMY

SEQ ID NO: 17441 - protein, 344 aa, Thanatephorus cucumeris
MTVKIGINGFGRIGRIVLRNAIEHGDVDVVAVNDPFIDLEYMVYMFKYDSTHGRFKGEVKADKDNKQLVINGKNIAVHSERNPGDINWDASGAEYVVESTGVFTTIEKASEHFKKSPSLKKVIISAPSADAPMHVVGVNLDAYDPKGPKVISNASCTTNCLAPLAKVIHDKFGIVEGLMTTVHATTATQKTVDGPSAKDWRGGRGASANIIPSSTGAAKAVGKVIPSLNGKLTGLAFRVPTSNVSFVDLVARLEKPATYDEIKAAIKEASEGPYKGIFGYTEDDVVSTDFVGDQHSSIFDSKAGISLNKKFVKLVSWYDNEWGYSRRVVDLIAYVAKKDKEAGC

SEQ ID NO: 17442 - protein, 503 aa, Hordeum vulgare
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 17443 - protein, 334 aa, Clostridium thermocellum
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 17444 - protein, 499 aa, Candida tropicalis
MAISSLLSWDVICVVFICVCVYFGYEYCYTKYLMHKHGAREIENVINDGFFGFRLPLLLMRASNEGRLIEFSVKRFESAPHPQNKTLVNRALSVPVILTKDPVNIKAMLSTQFDDFSLGLRLHQFAPLLGKGIFTLDGPEWKQSRSMLRPQFAKDRVSHISDLEPHFVLLRKHIDGHNGDYFDIQELYFRFSMDVATGFLFGESVGSLKDEDARFSEAFNESQKYLATRATLHELYFLCDGFRFRQYNKVVRKFCSQCVHKALDVAPEDTSEYVFLRELVKHTRDPVVLQDQALNVLLAGRDTTASLLSFATFELARNDHMWRKLREEVISTMGPSSDEITVAGLKSCRYLKAILNETLRLYPSVPRNARFATRNTTLPRGGGPDGSFPILIRKGQPVGYFICATHLNEKVYGNDSHVFRPERWAALEGKSLGWSYLPFNGGPRSCLGQQFAILEASYVLARLTQCYTTIQLRTTEYPPKKLVHLTMSLLNGVYIRTRT

SEQ ID NO: 17445 - protein, 87 aa, Oryza sativa
MALSLMASRATTVCPLQGLKSTAGMPVARRSGNSSLCNVSNGGRIRCMQAWPIEDIKKFETLCYLSPITVEDLLKHIEYLLRSKWVP

SEQ ID NO: 17446 - protein, 963 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIVWVLSFLAHGYATEEFEVTEERLGVYRPEEHIDNPLGYADGKDAREYDPRLRGPVHPAELEIDPNTGMKNYIANEELAHRERWDTTSAGYIRFSLQRCIHYGRLYTSGSHGRGKESDLCEALRCLGQALHTLEDFPAHSNYCELALIDIHEKETRSESRIFPHVGTATRITLNNGKLVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEEENSRSAGNVNVVPGMSPNFDPVKTAAKIYPILEFRDKIVRSINNMIEKIPGLESLLEKISETLTAFVLGLLAPFLRPIINQVTQVLKEGSSGLIATSASQQLEPWNDRQWDNPTHCMLSKDQFTNVLNSCAGRVGATILQYVVPRVVYAWENPGVPEYEVIDDVLQVLHHPANVNPRIEIQCMMYNTVKQWRQEFKDMGRLEQLLSSESVKEGLNHILNGQSTNRGPGGGHTSCGGDGGHGKVAGSLWSQIKNRDLDTSAPSGGVSGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSTQPSYGAHPSQPPYGFQPHYGGPPHGSYSGGRPPSPPRPSGYGGGYAGYSAGPPPSHGGYGGYGGGPSGGAPYPHGGPVGGGGSAPYPHGGRADAYERNYDQHYERDERRGDRGSRRRRGSHGSRSSSEERDGRGYPGQGSRGSGHHGGGGGYGGGYGGGYGGGYGGGGGYGGGYGGRDEHRRY

SEQ ID NO: 17447 - protein, 334 aa, Saccharomyces kluyveri
MAPHVNKKQKLSNSLEQLKATGTVVVSDTGDFESIAKYTPQDATTNPSLILAAAKKENYAKLIDTAVEYGKKQGKTLEDKVDQAVDMLLVEFGKAILNIVPGRVSTEVDARLSFDKDATVAKALHIIKLYEDAGISRERVLIKIASTWEGIQAAKELEEKHGIHVNLTLLFSFSQAVAAAEAKVTLISPFVGRILDWYKASTGKDYTAETDPGVKSVRKIFNYYKKYGYDTIVMGASFRNVGEIKALAGVDFLTISPGLLDELMSSEDPVPQVLDAEAAKSEDLAKVSFISDEAKFRFELNEDAMATEKLSEGIRKFSADIVTLFELIEKKIKA

SEQ ID NO: 17448 - protein, 87 aa, Zea mays
  unsure (1)..(87): unsure at all Xaa locations
FGQPKGFAYVEFLKLNXFQEAIKLNESELPGRQLKVAPKRTNVLGMKHPPGRGFNPYHGPPYMRPDGYSPYGYGRFPRFPRPRSPYF

SEQ ID NO: 17449 - protein, 396 aa, Sesamum indicum
MALKLNAINFQSPKCPSFALPPVASVRSPKFFMASTLRSGSKEVETVKRPFNPPREVHVQVTHSMPPQKIEIFKALEDWADNNILVHLKPVEKCWQPQDFLPDPSSDGFDDQVKELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARLAREHGDLKLAQICGTIAADEKRHETAYTKIVEKLFEIDPNDTVLAFADMMRKKISMPAHLMYDGRDDNLFDHFSSVAQRLGVYTAKDYADILEHLVARWKVANLTGLSADGRKAQDYVCGLPPRIRRLEERAQGRAKQAPKIPFSWIHDREVQL

SEQ ID NO: 17450 - protein, 296 aa, Zea mays
MYSCRLPLASLHTSRRAEHAPFPFSSPPDPPAAPPLSAPPRRRRPFPRPPPFLSGVYMGSKSVDEVLDAAAGVHCSALRLDGPNVQFSASSEEEPTTSGLENGHQEPFVIGVAGGASSGKSTVCKMIIDQLRDQRVVAVTQESFYYGLTDEELVHVHDYNFDHPDAFHTELLLSCMQNLKHGKAVDIPNYNFKTYKSVPNARKVNPSDVIILEGILVFHDSRLRDLMNMKIFVDTDADVRLTRRIRRDTIDKGRDIKAVLDQYSKFVKPAFGDFILPTKKYADIIIPRGGDNDVAI

SEQ ID NO: 17451 - protein, 474 aa, Ralstonia metallidurans
MGLRSQSRHPSGDSLKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAKPKADALLARETSVS

SEQ ID NO: 17452 - protein, 349 aa, Clostridium thermocellum ATCC 27405
MNVKALFLAGGLGTRLRPITNDLPKPMVPIMGKPLLERNIEKLKSYGIDEVVLSTCYKPHKIDKYFGDGKKFGVKISYITEDKPLGTAGAIKNAEELLSDTFLVFNADILSDIDIANMIRFHKEKGALATIAVTKVDNPSAYGVIEHDDDNFITAFKEKPQPHESKSNLINAGVYIFEKELLNHIPRGRAVSIERETYPLLLEKGYKMAVYNKCGYWLDLGTPGKYLKVHKDILKGLVPIGNYDFGQNRTYISKSAKIDRSAKIRGPVYIGENVVIGPSAVIGPNAVLFDDAVVGMGAKVVDSVVWDNVNVERGATVVNSVIMSNCRVDEDSEKYNSVLTENFSEPIAV

SEQ ID NO: 17453 - protein, 338 aa, Hypocrea ceramica
MAPIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 17454 - protein, 403 aa, Oryza sativa
  unsure (1)..(403): unsure at all Xaa locations
TRHRSAVPSGASTGIYEALERRDGDGAAYGGKGVLNAVRNINEVIAPKLVGVDVRNQSDVDAIMLDIDGXRPNKSKLGANAILGVSLSVCRAGAGAKEVPLYKHIQELGGAEELVMPVPAFNVINGGSHAGDNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAYVISAQHLCDRVRPRVRDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQLLRIEMELGNVRYAGEAFRSP

SEQ ID NO: 17455 - protein, 554 aa, Schizosaccharomyces pombe
MRLFGNSKEQGICQVGESDVAVSEIKKDEALLQKMGYKPKLHRTYAFFENFASSFAACDCMSNIRGSFYIGLLTGGPSAYWITYIIAIPLQLISAATMAEVCSALPTAGSLYFWASAAGGKKYGRLIGFIVAWWVVVAWTSFVAVNCQSTTKFIFGELPVFNSGFSVSSSDVKFRAVQWAVGEAILLVCVLLNFIPPKWFRYIFRVSVAVILLDFVLNMIWLPIAVSTKYGFRDEAFMKSTNYDLGKVNNGWSWCLTFFCTARILVGYDAAGHVAEETKNASKTASRGMFYSAFSNAILSTGIIVMFLYCLPPSNVMYELIKSNSQQPFVSFYAYALGKRAHVFMNVVGILGMIFDTSLSIVASSRLVFAVARDGVLPFSGWLRKVDSHGQPTNAVTFIFLISAALLCSNLPSAVAFTSLLSAAAVPTIMAYAAVAFGRLFLSRNDFPKSEWSLGKLSKPFQLITFLWNLFTAVILFSPKAYPVTGKNFNYAPVIFGAITIFGLISWLSIPASRWSTFYDASKLDSNSFDDSSSDKKSLEKAASIAEGSITQII

SEQ ID NO: 17456 - protein, 361 aa, Neurospora crassa
MSVPEKFTGFQVNGPETWTEFHKNEFQPKPFGDYDVDIKIECCGVCGSDVHTISGGWGEQKFPLAVGHEIIGTALRVGPKVTLIKPGQRVGVGAQSYSCLDCRQCKNDNETYCRKQLDTYGAVWPDTGIVSQGGYSSHVRTHEHWVFPIPDALPSTVAAPMLCAGLTAYSPLVRNGCGPGKKVGIVGLGGIGHLGLLFAKALGATVYVISRTHSKEADARKMGADGFLATADPNWNEEHIMTFDLIINTANSFEGFDLDAYLSLLDVHGKWVSVGLPEDEEGIRVRNQTFLKNGCFFGSSHLGSRRETLEMLQLAADKGVRTWVEEVKINEENLKGVMQKMKGAGGRYRFCLTGYEEAFGA

SEQ ID NO: 17457 - protein, 340 aa, Zea mays
MRPSLLKSTAELLRRSRGYASSANPERKVAILGAAGGIGQPLSLLMKLNPLVSSLSLYDIAGTPGVAADVSHINSPALVKGFMGDDQLGEALEGSDIVIIPAGVPRKPGMTRDDLFNINAGIVKALCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNDFEKKGLESLKVELKSSIDKGIKFAHGS

SEQ ID NO: 17458 - protein, 112 aa, Zea mays
  unsure (1)..(112): unsure at all Xaa locations
PARGQAYFSDANSHKLGAIVYITILNHLINNQNXYCMEVTPKTLADFXGGTLIYYEXRVYLLXIALVSDEHVNEFKSIYKFKKFNTXNSWVNLKAFXRLLEAESLKTVFFSN

SEQ ID NO: 17459 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 17460 - protein, 490 aa, Pseudomonas putida KT2440
MKDLAPSALNKLRRNDLLETRAYIDGRWVTGEGSLDVTDPANDQVIAQVAHCDESWVDLAVEAASRAFDGWRNTLPTQRGAVLRKWAALMRENQEDLAVIMTCEQGKPLSESRGEINYGANFVEWFAAEGERCYGETIPSHLPNSQLVTKLQPIGVTVAITPWNFPSAMITRKAAAALAAGCPMIVKPAPETPLSALALARLAEEAGIPGGVFQVLTGDAPKMSARLLAASAVRAFSFTGSTEVGRILLRQSADTVKKVSLELGGHAPFIVFDDASIAEAVEGCIGAKFATSGQDCLGANRIYVHRNIYGQFVEEFTKATEKLRVGHGLEEGVDIGPMTRVTVANKCREQISNALSLGAKLTCGGIDNHLGSSFVLPTVLADVTDKMDIAFEETFGPVAAILPFDSEDEVVTRANNTEFGLAAYVYTNDLRRACRVSDRLEYGMVALNTPKFTGAPIPFGGWKQSGLGREGSKHGLAEYMELKYVCIGGL

SEQ ID NO: 17461 - protein, 460 aa, Pseudomonas putida KT2440
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDSGGFMPNGFGTVLGGVLITIFSFFGAEIVTIAADETANPKDKIRRATNLVVYRIAIFYLASIFLVVSLVAWNDPGLKAVGSFQRVLEVLNVPGAKLLVDLVVLVAVTSCMNSGLYTASRMLYSLGARGQALSVTKRISGSGVPTVAVIFSTLAGFAGCFVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRAKMVAQTA

SEQ ID NO: 17462 - protein, 177 aa, SYNECHOCOCCUS SP. WH 8102
MKAGELSLGQSLDLPALDRVDTLAQELALLQDKGKRRIAILGSRHVPVVAIHLVQLVARSLVQEGHSLITSGSQGVNAAVIRGCLDVDASQLTVLLPQSLDRQPTEIRDLLDRVLHLVEKPEQDDLPLPMASSLCNQEIINRCDQLICLAFHDSETLLSSARTAEDMGKVVSLLYFD

SEQ ID NO: 17463 - protein, 314 aa, Lycopersicon hirsutum
MGSKYSKATNSISDASNSFESYRFPLVDLEEATNNFDDKFVIGESGFGKVYRGVLRDGTKVALKRHNRDSRESIEEFETEIEILPRRSHPHLVSLIGYCDDRNEMILIYDYMENGNLKSHLTGSDLPSMSWEQRLEICIGAARGLLYLHTNGVIHRDVKSTNILLDENFVPKITDFGLSKKGPQLYQTHVSTNVKGTFGYMDPEYVIRQKLTEKSDVYSFGVVLFEVFCARSTIDPYLRREIVTLAEWAVKSHNNGQLEQIVDPNLAAKIRPESLRKFGETAVKCLALSGKDRPSMGDVLWKLEYALCLQESVI

SEQ ID NO: 17464 - protein, 203 aa, Drimys winteri
GGLFKKAHELAVLCDVQVGLVIFSTSGKMFEYCNPQSSMRQLFDRYQKVSGNRIQEYDNQQIYCEMTKLKHEYDKLHTSMRHFTGDDLSTLSLNDLHQIEEQLEISVNKVRGRKNQLLHQQMENLSRKGHILEDQNNHLYRLLAEHQASMEQKVVDQPMLDHFGALLAYQDEQARNMLQLSPQLHAFRLQPTQSNLQDANLQL

SEQ ID NO: 17465 - protein, 173 aa, Zea mays
  unsure (1)..(173): unsure at all Xaa locations
LTHTTFIKIMNQPEWLARTHAGHAPCAVKGXPCTSVWLELCDKATACRRGQGRLMHMWXAAHNLWVGSAFMARGISCDTVQLFAAKYRDEGLKESGPYGLDVTLAFLGDRSCYNGQFFEWRNMAQIWKHPIVLAGENNQREIRMIHIMATSDPKXCNKGPAFAMPGAHVDGMD

SEQ ID NO: 17466 - protein, 184 aa, Triticum aestivum
  unsure (1)..(184): unsure at all Xaa locations
MAPTVMASSATSVAPFQGLKSTAGLPVSRRSNGASLGSVSNGGRIRCMQVWPIEGIKKFETLSYLPPLSTEALLKQVXDYLIRSKWVPCLEFSKVXGFIFREAQMRLPGYYDGRYWDNVESCLMFRGATDAXTQVINEGWREGQRKEYLTRYVRIIGFDNMRQVQCVSSMPQATGCKIRKAKQY

SEQ ID NO: 17467 - protein, 350 aa, Zea mays
  unsure (1)..(350): unsure at all Xaa locations
MGYARTLKAAAAAVXLAAGGVRFLGPALAAFVTEELPRARAVAATWLTPPYLYLVINAIIISIAASSRFQPSDGGRPSAPSYAPAADAGAGAIGVGGAGDEIEQDGIQPAVVLQLQVPAAMPLVAVKAAAVAAVEEREPVVEVHTTEVAPVPPDEVDEDYSISRSTWTPRRRGEEPEVAADVETDVLPFTDLTNSRDKPLVSARFSRKAAKASPEGSRALRVARPRKEETLESTWKAITEGRGPPLARHLKKSDTWDARPGRRPGGSGKVDPAAVAPAGAMRKAETFNDGGRAGRSKAPPAPVRREPSLGQDELNRRVEAFIHKFNMEMRLQRQESLKHYSDMLGRGIRY

SEQ ID NO: 17468 - protein, 1591 aa, Oryza sativa
MSRSVQLAVAAGDQVDPDSLRLHQLGYKQELKRGLSALSNFAFSFANISVMMGVTTTYNTGLRYGGPVSMTLGWLVVAVFNCCVALSMAEICSAYPTSGGLYYWSAKLAGKQWASLASWVTGWFNVVGQWAAIASVDFSLAQLLQVIILLSTGGGNGGGYMASKYTVLAIYAFILILHGIINSLPIEWLSLFGHVGAIWNAAGIFVLTILIPAVAKDRPNIEFVFTHLNTENGMGIHDKAYILAVGLLMSQYSVIGYDTSAHMVEETKNADRSGPIGIITSVLFATVFGWIYLLALTSVVTDIPYLLSPSNDAGGYAIAQALYTAFHRRYGSGVGGIVCLGAVAVAVFLCGIACVTSNSRMAYAFSRDGAMPLSRVWYRVNKHEVPLNVVWLGVAVAFVMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVALFGPVFIAALFFPLVRRARRAAAIREYATAGSSPPACNGFACGGAFESSTTGGACSRRGGAPAPFACDCPAAQPCALPCPASMRALVASSALLRRSAARANLSGAGFCNGAPPVSSPLRRFPLQGIKKSEGISVSLRRLQVFALDVQLDYETDPPLDGVKVLEKESTLSVAVSQLASDFDRESNLCLERFSRTRRTPVISTGSLKLDIALGIGGLPKGRMVELFGKEASGKTTLALHVVKEAQKKGGCCAYIDAENAFNPSVAEAIGVNVEKLLIAQPDSAENSLSIVNTLVGGSIDVVVVDSVRTKLSSNQTPGIFKEVACGGNALGFYAAVRMRTSRRELRYNEAQATGIGISVQIIKNKLAPATLKEAGIDIRFGKGICYESEILELASSLGVIMKDDSGYWINGEFLPNKAEAEKFLRENAAVADEICAALAIAAFASFPSGTHIAKLRYIMRSIGVCYGMNGDGLPSRSNVVQLYKSNGIGAMRIYSADREALDALRGSGIDLALDVGERNDVGQLAANADSWVQDNVKAYYPDVKIKYIVVGNELTGTGDAASILPAMQNVQAALASAGLADSIKVTTAIKMDTLAASSPPSAGVFTNPSVMEPIVRFLTGNGAPLLANVYPYFAYRDSQDIDLSYALFQPSSTTVSDPNGGGLSYTNLFDAMVDAVRAAVEKVSGGGSSVVDVVVSESGWPSDGGKGATVENARAYNQNLIDHVAQGTPKKPGQMEVYVFALFNENRKEGDATEKKFGLFNPRQDTAALLLLGVFISIPVDNEGVQSVGVCYGMIGNDLPSKSDVVQLYKSNGITDMRIYLPDVEAMNALRGTGIGLIVGVANDILIDLAANPASAASWVDANVKPFVPAVNIKYIAVGNEISGEPTQNILPVMQNINAALAAASITGVKASTAVKLDVVTNTFPPSAGVFAAPYMTAVAKLLASTGAPLLANIYPYFAYIGNKKDISLNYATFQAGTTVPDPNTGLVYTNLFDAMVDSVYAALDKAGAAGVSIVVSESGWPSAGGDSATIDIARTYVQNLIKHAKKGTPKRPGVIETYVFAMFNENQKPGEATEQNFGAFYPNKTAVYPINFQ

SEQ ID NO: 17469 - protein, 262 aa, Brassica napus
MKALGLSFFQDCPLEEKLQYACDSTSAASEGYGSRMLLGAEGDVVLDWRDYFDHHTFPLSRRDPSHWPLRPPHYRQVVEEYGNEMKKLAQKLLGIISESLSLPCSSIEEAVGEIYQNITMSYYPPCPQPELTLGLQSHSDMGAITLLIQDDVGGLQLYKDDQWLTVPPISHAILVLIADQTEIITNGVYKSAQHRAVTNANRARLSVATFHDPSKTARIAPASHLIGQHTKPAYKEVVYGQYVSSWYSKGPVGKRNLDALLC

SEQ ID NO: 17470 - protein, 307 aa, Helicobacter pylori 26695
MLVKGNEILLKAHKEGYGVGAFNFVNFEMLNAIFEAGNEENSPLFIQTSEGAIKYMGIDMAVGMVKTMCERYPHIPVALHLDHGTTFESCEKAVKAGFTSVMIDASHHAFEENLELTSKVVKMAHNAGVSVEAELGRLMGIEDNISVDEKDAVLVNPKEAEQFVKESQVDYLAPAIGTSHGAFKFKGEPKLDFERLQEVKRLTNIPLVLHGASAIPDNVRKSYLDAGGDLKGSKGVPFEFLQESVKGGINKVNTDTDLRIAFIAEVRKVANEDKSQFDLRKFFSPAQLALKNVVKERMKLLGSANKI

SEQ ID NO: 17471 - protein, 341 aa, Chlamydia trachomatis
MTTWDLAMRIVINGFGRIGRLVLRQILKRNSPIEVVAINDLVAGDLLTYLFKYDSTHGSFAPQATFSDGCLVMGERKIRFLAEKDVQKLPWKDLDVDVVVESTGLFVNRDDAAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSIFDAQAGVALNDRFFKLVAWYDNEIGYATRIVDLLEYVQENSK

SEQ ID NO: 17472 - protein, 488 aa, Cyanidium caldarium
MAQSVQERTRLKNKRYESGVIPYAKMGYWDPNYVVKDTDILALFRVTPQPGVDPIEASAAVRGESSTATWTVIWCDLLTACDVYRAKAYRVDQVPNSPDQYFAYIAYDLDLFEEGSIANLTASIIGNVFGFKALAALRLEDMRIPIGYLKTFQGPATGVVVERERLNMFGKPFLGATVKPKLGLSSKNYGRVVYEGLKGGLNFLKDDENINSQPFMRWRERFLYVMEGVNRASAATGEIKGSYLNVTAATMEEMYNRAACAKEVGSIIIMIDLVIGYTAIQSMAIWARENNMILHLHRAGNSTYARQKNHGINFRVICKWMRMAGVDHIHAGTVVGKLEGDPIIVKGFYNTLLLPKLDVNLPQGLFFEMDWASLRKTVPVASGGIHAGQMHLLLKYLGDDVVLQFGGGTLGHPDGIQAGATRNRVALEAIVLARNEGRDYVNEGPQILKEAARTCGPLQTSLDLWKDISFNFTSTDTADFVETPTANV

SEQ ID NO: 17473 - protein, 467 aa, Zea mays
LVKTQDPSSMPANMISKILEKSSVLPLVDDVIAPIHVKTAGGAPRTSVMRNPNMEKLQKGYLFPEISIKREAHLKKYPHAKVISLGIGDTTEPIPSVVTSAMAEYVLALSTPEGCQGYGPEQGQMNLRKVIAEEVYPDMGIQESEVFISDGAQCDIARLQTLFGPNVTIAVQDPTFPGYVDNGVIVGQTGSADEAGKYAGIAYMRCAPENHFFPDLSRVPRTDVIFFCSPNNPTGHAASAAQLRELVDFARRNGSIIVFDTAYAWYVSSSSEAAGDGDKMKPRSIYEVPGAREVAIEISSFSKFAGFTGVRLGWAVVPDELRYADGSPVARDFDRIVCTCFNGASSVAQAGGLACLSTEEGRDAVRRVVGVYKENARVLVDTFASLGKEVYGGTDSPYVWVRFPGRRSWDVFAEILDKTHVITVPGSGFGPGGEGFIRVSAFNSRDRVLEAAARLKKFLPGLSAVPL

SEQ ID NO: 17474 - protein, 504 aa, Xylella fastidiosa Dixon
MPTRKKSMDCKVRRLGMPIALAVSDCYPNPKRFPLMSLENVEKLVKDKKIEFVDLRFVDMRGVQQHVTFPVNILEPSLFKDGKMFDGSSIAGWKGINESDMVLLPDASTAYLDPFYADPTLVMTCDILDPATMHSYVRDPRGIAKRAEIYLNSLGIADQAFFGPEPEFFIFDSVRFANDMGHSFFQIASEEAAWNTGAEFERCNSGYRPAVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFINGYIALKMQEVTQFRAATHPLEYQMYYAN

SEQ ID NO: 17475 - protein, 359 aa, Kluyveromyces marxianus
MSKNIVVLPGDHVGTEITNEAIKVLNAISEARPSIKFNFEHHLIGGAAIDATGVPLPDEASKKADAVLLGAVGGPKWGTGSVRPEQGLLKIRKELGLYANLRPCNFASDSLLDLSPLKPEYAKGTDFVVVRELVGGIYFGERKEDEGDGVAWDSEKYSVPEVQRITRMAAFLALQHNPPLPIWSLDKANVLASSRLWRKTVEETIKNEFPQLTVQHQLIDSAAMILVKSPTKLNGIVITNNMFGDIISDEASVIPGSLGLLPSASLASLPDTNKAFGLYEPCHGSAPDLPANKVNPIATILSAAMMLKLSLDLVEEGRAVEEAVRKVLDSGIRTGDLGGSNSTTEVGDAVAKAVKEILA

SEQ ID NO: 17476 - protein, 683 aa, Debaryomyces hansenii
MSDAKDTEDNLSPRFENLNIRTPKAANPENMQSPQRLSHSQINGDIQARILAFQQKRTKPVNGGHGGLNSIPASSNHLSEAPDKPLPPLPPLPSLPKLPNVQAQQRSYSLGDANDLGVIPSPMETENIHTTNQTMNQTMNRGINQSIGQGMSRASSIKKQDSQQLPFELLKKPSLSQRRGMKLNLSEMSSPNSASSPDDTSPIGDDKKNPVFLNAPKGNDIESGAMNTTGDLSRMLSDRKKKPNFKLNLGNTGVPGVNGMQNSQSNSNTNSTASSLDSSGSSSTAGTNNETNQSKKPQLQGLFANYSKYVDIKSGSLNFAGKASLHSKGIDFLSGLLFRISLEELEFLEELGHGNYGVVLKVLHKPTGVLMAMKEVRLELDETKFTQILMELEILHKCDSPYIVDFYGAFFVEGAVYMCMEYMDGGSLDKIYGKDDGVKDEACLAYITECVISGLKELKDEHNIIHRDVKPTNILVNSLGKVKLCDFGVSGNLVASLAKTNIGCQSYMAPERIKSLSPTDNTYSVQSDIWSLGLSILEIAAGHYPYPAETYGNIFSQLSAIVDGDPPKLDPKIFSKDAQLFIKSCLNKNPDLRPSYATLLKHPWLVKYRNIDPHMGEFVTKKIQELEEEKNKKNLSRSNSTSSSAATAKPPKENVRSLLKGKVQAPALHRGGLMNSSRNNANR

SEQ ID NO: 17477 - protein, 233 aa, Oryza sativa
  unsure (1)..(233): unsure at all Xaa locations
QEDLYYPHPFVQDVLWATLHKFVEPAMLRWPGNKLREKALDTVMQHIHYEDENTRYICIGPVNKVICMLACWIEDPNSEAFKLHIPRVHDYLWIAEDGMKMQYNGSQLWDTAFTVQAIVATGLIEEFGPTLKLAHGYIKKTQVIDDCPGDLSQWYRHISKGAWPFSTADHXWPISXCTAEGLKAALLLSKISPDIVGEAVEVNRLYDSVNCLISLMAEGRVTNACSLTLLYRA

SEQ ID NO: 17478 - protein, 468 aa, Tilopteris mertensii
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPAKGVIVERERLDKFGRPLLGATVKPKLGLSGKNYGRVVYEGLAGGLDFLKDDENINSQPFMRWKERFLYCMEGVNRAAAATGEVKGSYLNVTAATMENMYERAEYSQAIGSVICMIDLVVGYTAIQTMAIWARKAEMILHLHRAGNSTYARQKNHGINFRVICKWMRMCGVDHIHAGTVVGKLEGDPLMVRGFYNTLLLTELKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWRDITFDYTSTDTPDFVEVATESN

SEQ ID NO: 17479 - protein, 110 aa, Yarrowia lipolytica
MPRVIIRREVLTQTQHFWIDFLMGGVSAAVSKTAAAPIERVKLLLQNQEEMIKQGRLSRPYKGIIDCFRRTWGEEGLASFWRGNTANVIRYFPTQALNFAFRDKFKAMFG

SEQ ID NO: 17480 - protein, 394 aa, Triticum aestivum
  unsure (1)..(394): unsure at all Xaa locations
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTXASPGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 17481 - protein, 314 aa, Mesorhizobium huakuii
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 17482 - protein, 113 aa, Oryza sativa (japonica cultivar-group)
MGEIRALRNMDDDEVFAYAKRIAAPYDLVMQTKQLGRLPVVQFAAGGVTTPADAALMMQLGCDGVFVGSGIFKSGDPARRARAIVQAVTHCRLSRPSTPPPRRPRWRKKERKR

SEQ ID NO: 17483 - protein, 396 aa, Cucumis sativus
MALKFHPLTSQSPKLPSFRMPQLASLRSPKFVMASTLRSTSREVETLKKPFMPPREVHLQVTHSMPPQKMEIFKSLEDWAEENLLVHLKPVERCWQPQDFLPDSAFEGFHEQVVELRERAKELPDEYFVVLVGDMITEEALPTYQTMLNTLDGVRDETGASPTPWAIWTRAWTAEENRHGDLLNKYLYLSGRVDMRQVEKTIQYLIGSGMDPRTENNPYLGFIYTSFQERATFISHGNTARLAKEHGDIKLAQICGTITADEKRHETAYTKIVEKLFEIDPEGTVIAFEDMMRKKVSMPAHLMYDGRDDNLFHHFSAVAQRLGVYTAKDYADILEFLVGRWKVESLTGLSGEGQKAQDYVCALPARIRKLEERAQGRAKEGPTIPFSWIFDRQVKL

SEQ ID NO: 17484 - protein, 527 aa, Caulobacter crescentus CB15
MLHLPPHRRQLLGGLLALGVGASASRTHAAPTEAVANVRDFGAKGDGVTIDSPAIDRAIAYAAERGGGTVLVPAGTYACYTIHLKSRIRLYLDQGATILAASTPIEGMESGGYDHAEPMDPAYSSYQDFGHSHWRNSLIHGEGLNDIVIEGPGLIWGKGLGRGHDYDKDMPISGKPGVGDKSIALKNCRNVLLRDFKVLQGGWFALLATGVDNLTIDNLLIDTNRDGLDIDCCRNVRITRCTINSPWDDAICPKSSYALGYPRVTENLTISDCYVAGRYRIGSVLDGTWQVFMPAPKGTHGRIKLGTESNGGFKNFTITNCVFDKCRGIALETVDGGALEDITITNITMHGGTTAPIFMRLGKRMRGPEGRPIGTLKRILISNITSSAGDRMPSIIAGLNGHPVEDIKISQCFLEQVGGGDAAMAALRPPENEAGYPEPNMFGDLPATGFFVRHARNVELDGIEVRTLTPDARPAVWMQNVDGARLSRLQLPPSKSSFHLEGVRDFELRTSSPVRDKRVPHTKLMTF

SEQ ID NO: 17485 - protein, 306 aa, Agrobacterium tumefaciens str. C58
MLLIRRFEEKAGQLYGMGFIGGFCHLYIGQEAVVVGMQMSQKEGDQVITAYRDHGHMLALGMSARGVMAELTGRKGGLSKGKGGSMHMFSKEKHFYGGHGIVGAQVSLGTGLAFANRYRGNDNVSVTYFGDGAANQGQVYESFNMAALWKLPIIYIVENNRYAMGTSTARATAQSNYSLRGQSFGIPGVQVDGMDVRAVKAAADQALEHCRSGKGPIILEMLTYRYRGHSMSDPAKYRSKDEVQKMRSEHDPIEQVKARLLDHGWASEDELKAIDKDVRDIVADSADFAQNDPEPDVSELYTDILL

SEQ ID NO: 17486 - protein, 376 aa, Arabidopsis thaliana
MAKEIESATDLGDTNIKGVLVHGGRYFQYNVYGNLFEVSNKYVPPIRPIGRGAYGFVCPAVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANGGKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 17487 - protein, 367 aa, Eremothecium gossypii
MLRQKLFQGSRRWLASVRQPSIGRYAGKPNAAGKYTVSFIEGDGVGPEISQSVKDIFSAASVPVEWEYCDVTPLLVNGLTTIPEPAVASINKNLVALKGPLATPIGKGHRSLNLTLRKTFGLFANVRPAKSIEGYKTTYSDVDLVLIRENTEGEYSGIEHVVSPGVVQSIKLITREASERVIRYAFEYARTVGRPKVVVVHKSTIQRLADGLFVNVAQELGREYPDIELQTELLDNTVLNVVTKPEAYKDVVAVCPNLYGDILSDLNSGLSAGSLGLTPSANIGHQVSIFEAVHGSAPDIAGQNRANPTALLLSSVMMLNHMGLHEHAGRIEKAVLSTIASSRENRTADLAGTASTSSFTNAVIERL

SEQ ID NO: 17488 - protein, 486 aa, Prochlorococcus marinus subsp. pastoris str. CCMP1378
MTTALQTPQRRSRSKLQDASLVNGPMLLLRSIRGFSSNRSMLWLATVPLALFGLGIFNLSAHAADLPELNAAFLANNLWLLIATILVIFMNAGFAMVEAGMCRSKNAVNILAKNLFVFALAVTSYWFIGYSLMYGGSVADGWLYFGGLFFDPTVTADMVTDAGLVPTVDFLFQSAFAGTAATIVSGLVAERVKFGEFVVFAIVLTAFIYPIAGSWKWNGGWLDSLGFVDFAGSSIVHSVGAWAGLVGAMLLGPRIGKYSDGKPQAMPGHNMAIATLGALILWIGWYGFNPGSQLAMDQWVPYVAVTTTLAAAAGAIGATIVSTLTSGKPDLTMIINGILAGLVSITAGCGDMTLAGAWFAGLVGGIIVVFSVAALDAAEIDDPVGAFSVHGVCGVWGTLVIGLWGTAVQGDGAGMGLFNGGGINLLLVQALGAAAYAIWTLVTCWIAWSIIGGLFGGIRVSEEEETQGLDISEHGMESYPDFASAK

SEQ ID NO: 17489 - protein, 239 aa, Eremothecium gossypii
MVKPIIAPSILASDFANLECGCHRVINAGAEWLHIDVMDGHFVPNITLGPPIVKSLRKAVPRVGDKESDKPKAFFDCHMMVAEPEKWVDVFVENGADQFTFHYEATKNPLELVKLIKSRGIRAACAIKPDTPVDVLFELAPYLDMALVMTVEPGFGGQKFMPDMMPKVAALREKFPQLDIQVDGGLGKETIPHAAKAGANVIVAGTSVFAAADQKDVISYMKDNVRDELRSRGLLDIDM

SEQ ID NO: 17490 - protein, 162 aa, Glycine max
  unsure (1)..(162): unsure at all Xaa locations
VMDFSFRSRRKRGXVGIGVVALLASAIWGGALANQIKHDPGVILDFKDSGSRYAGPFVLYFSFGLLDAVFQSMVYWVIGALANDSEILSRYAGFYKGIQSAGAAVAWQIDNHNVSAMAQLIVNWVLTTVSYPLLLILVVLAVKEGDNRGEEEPVKEVAGFAH

SEQ ID NO: 17491 - protein, 254 aa, Triticum aestivum
GGGRHRRLLSATPLRPETDGGKPQEVKLREAGHGRRFWDVKVVLDADGHMYLERGWEQFARAHDLRLGYFLVFSYDGDAVLTVKVFDVSMCRRHYKHDGDTSSESSSDGDSGSSNTSDGGSGGNNRSLVEMDVEDGPTGQFSAMLRKCNLGMKQEQYLNVPVDFQLAHGYAERSKVELRMRGKSWLVHLKHNPKTGGRSRASFRYGWHQFCVDNALGEGDTCFFRALRQGSAGGGGEDHLLKVEVRRRDGSFLV

SEQ ID NO: 17492 - protein, 318 aa, Glycine max
  unsure (1)..(318): unsure at all Xaa locations
MGSEVSKQVERRKAIHTEGKTLSDLRNSGEDYPGSDYHPSDRKKWMSELNPEKVVIKQIVWPGTHDSATNKIGIPCITRPFAQCQSLSIYQQLVLGTXRVIDIRVQEDRKVCHGVLVTYSIDVVIKDLKKFLSETQSEIIILEVRTEFGHEDPQEFDKYLEEQLGDYLVPQDDKVFEKTIAEVLPKRVICVWKPRKSPQPKAGSPLWSAGYLRDNWINTDLPSTKFESNMKHLSEQQPVTSRTYFYRVENTVTPVADNPVLCVKPVTERIHGFARLFISQCFSKGYADRLQIFSTDFIDQDFVDACVGLTRARVEGRA

SEQ ID NO: 17493 - protein, 278 aa, Triticum aestivum
  unsure (1)..(278): unsure at all Xaa locations
IPTHAIATAASRAGAPPPREQRDAPHRRILPPPPSRAFLHLPVPALHPPLPLPPLLPHLRPPLPPLPHVLHCPHRVSFPVPTSPSAALLPLPSWCAHPSLPYLALKAVTSFPANSPHRPSIHATVSLFSSASGVPLASVEGSALTLLRTAAVSAXLAASLLVSPSRPPSTLALAGAGALAPYLADAHLSALPSLSRILVWNRTKAKSAALVAKLRDAHPGVAVEEVDGMDEAVSAADIVSCATGSQEPIVRGELLKPGAHLXTLVGSFTPAMRECDDE

SEQ ID NO: 17494 - protein, 509 aa, Streptomyces coelicolor A3(2)
MANSTHTPAERAHRTIHAGGEWLAASSGATREILDPADAVAFAVVAEGDEKDTDLAVAAARRAFDAGDWPHTPVAERAALLRRVAGLLVRDREKLGLLESRDAGKTVEEGRVDIDCVADAFRYFADLVAGEAPGRVVDAGSPEVHSVVVHEPVGVCAMITPWNYPLLQASWKIAPALAAGNTFVIKPSEITPMTTIALIDLLVEAGLPTGVANIVTGPGHTVGARLAEHPDVDLVSFTGGLTSGVKVAQAAAVTVKKVALELGGKNPNVVFADACATEEGFDTAVDQALNAAFMHSGQVCSAGGRLIVEESVRERFVAELARRAERIRLGRGTEEGVECGPLVSAQQRAKTEDYVASALAEGAELRCGGKRPEPSPQRPESGYFYEPTVLDHCHREMRVVREEVFGPVLTVETFRTEDEAVALANDTEYGLAGAVWTADAGRARRVAGRLRHGTVWINDFHPYLPQAEWGGFGKSGVGRELGPAGLAEYRESKHVYQNLAPKPVRWFSG

SEQ ID NO: 17495 - protein, 457 aa, Halopteris filicina
  unsure (1)..(457): unsure at all Xaa locations
DYNVKDTDILALFRITPQPGVDPVEAAAAVAGESSTAXWTVVWTDLLTACDIYRAKAYRVDPVPGTSDQFFAYVAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNVTAGTIENMYERAEFAESVGTVIAMVDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEGRDYVAEGPEILRGAAKTCGPLKAALDLWKDITFEYTSTDTPDFVEVGTESN

SEQ ID NO: 17496 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKIHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGAPANRVALESMVLARNEGRDYVGEGPEILRRAATTCGPLKAALDLWKDITFDYTSTDTPDFVEVATESR

SEQ ID NO: 17497 - protein, 343 aa, Geobacillus stearothermophilus
MNNKMLGVIDATTYIEALEPLIEQRSIAAVPFAGRYRLIDFVLSSMVNSGIESVAIFPKYQYRSLMDHLGSGKNWDLNRKRDGLFFFPSPDLLFSGERRVGAFAHFEQHIDYFLRSRQKYAVIANGYTVCNIDFDAVLNRHIENGCDVTEIRHRGRSLEMYLLETSLLLDLIADYKNHGYYSIVDVIRDYHRSLSICEYEYSGYAAVIDSVEQYFRSSMELLDRDVWEQLFLPSHPIYTKVKDEPPTKYGREGNVKRSMIANGCVIEGTVENSVLFRSVKIGKGAVVRNSIIMQKCQIGDGCVLDGVIIDKDAKVEPGVVLKGTKEQPFIVRKGTVQGEVISR

SEQ ID NO: 17498 - protein, 554 aa, Zea mays
MTAPGGSNLAVLDALDSARTQMYHMKAIVIAGMGFFTDAYDLFCISTVSKLLGRIYYPDDNLYIDKPKPGTLPVSVNNMVTGVALVGTLMGQLVFGYFGDKLGRKRVYGITLVLMAACAIGSGLSFGSSAHAVIGTLCFFRFWLGFGIGGDYPLSATIMSEYSNKKTRGAFIAAVFAMQGVGIIFAGLVSMIVSGILLHYHPAPAWKENHDRSWQDQMPAADYMWRIVLMIGAFPALATFYWRMKMPETARYTALIEGNAKQAANDMQKVMDVEIQAEQDKLARYKAANDYPLLSREFARRHGLHLIGTATTWFLLDIAFYSQNLTQKDIFPAIKLTSPVDDINALKEVFEISKAMFLVALLGTFPGYWVTVALIDKMGRYLIQLIGFFMMSVFMLLMGVMYNDLKNKHTTLFALFYALTFFFANFGPNSTTFVLPAELFPTRVRSTCHAISAASGKAGAIVAAFGVQSLTLKGDVGHIKKALIILSVTNILGFFFTFLVPETMGRSLEEISGEDGNVENGPGAPAGVAMGVADVSKDDKMPVSSTEWQSSMHA

SEQ ID NO: 17499 - protein, 321 aa, Zea mays
LQLDLSDGGGAGGGAKAGAAAAAATSVELTGFVMGAEDAERAAAAAGVATVQDLLPLLVPSARKRAQVPISGFPVGAVGLGASGRVYVGVNLEFRGLPLCHSVHAEQFLVANAAAAGEPELRAVAVSHMPCGHCRQFLQEIRGAASIRILVTSDAAEGCAPEWRTVASLLLRPFGPNDLLPGDVPLVLEAHDNALGDPVANGLARGDLDARLRQAAEAAARAAHAPYSKCPSGFAVADGDGRIYAGGCLESAAYNPTLGPVQAAIIAMVAAGGGPAVDVVAAALVEKEQASVAQEATARIFLDAVAPHASFHVYNYRPSDA

SEQ ID NO: 17500 - protein, 567 aa, Schizosaccharomyces pombe
MSSIMEKTDVSSSKHSFTFEPSSDEVGKAAEIVDTHENFYDDQGDIDNPEELAELGYKQEFRRQLSLFGIFSISFSVLGMLPSVASTLVFGLWYVGYPGLLWAWLIAMFFLICVSMSMAEICSAMPTSGGLYYAAAVFAPKGWGPLASWITGWSNYIGNIIGQPSVNSSAASMILGAVTVNRPDFVIQRWQWFLLAVAIQCFNCVLACLPTRIISRINGVATYLNTAFLFIAGITILAYGGKNHNFVKGTKIWGDYINTTQWPTGFAILLSFNSPIWTMSGYDAPFHLSEECSNASVNAPKAIVMTAVIGGVVGWIMQIIVAYTLTDIDSVMNTSGSMWTAYLVQAMPPKAALGILSLTIISAIIMGQSALIASSRIAYSYARDGILPFSGWIGTVNPYTQTPVNAVICNCIISILILFLTFAGTVTLDAVFSVGAVAAFIAFTVPIAIRVFFTKDADFRRGPWNLGKFSRPIGLLAVSFVALMIPILCFPSVKNPTAQEMNWTCLVYGGPMLFTLVWYAISARKWFKGPKASAHYKRPGEESSDIVEGVQADIPSSSDQLKIKGDL

SEQ ID NO: 17501 - protein, 202 aa, Akebia quinata
RRNGLLKKAYELSVLCDAEVALVVFSNRGRLYEYANNSVKTTIERYKKACIDSSNSGSVSEANAQFYQQESLKLRQQIGNLQNLNRHLMGEALGSMSIKELKQLETRIEKGISRIRSKKNELLFAEIEYMQKREIDLQNDNMYLRAKIAENERAGQHMSLMPGNEYEVMSSAPFDSRNFLQVNLLEPNNHYSHTDQIALQLG

SEQ ID NO: 17502 - protein, 214 aa, Zea mays
MESFVQKHVVGVPLTSFAYADEERRGKPSCSAMVHKKNKKGSFICWMNKLSHKTDNYMQGFKEHLSLGPKVSETIKGKLSFGAKVLQAGGIDKVFREYFTVEEDEKLLKAFQCYLSTTAGPIAGMLFISTKKIAFHSDRPLNLLSPKGGRTRVPYKVLIPTKRIKSASVRGNLYNPDEKYIDVVTVDGFDFWFMGFVSYEKSFRYLQHAILELR

SEQ ID NO: 17503 - protein, 464 aa, Novosphingobium aromaticivorans
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 17504 - protein, 545 aa, Photobacterium profundum
MITPSEFKRLYKIIEVQLRYGLDDFLPEDPRTKMPKMARKSLFWIKNQHPDKSLGERLRLALQELGPVWIKFGQMMSTRRDLFPPHIADQLALLQDQVEPFDGNLAKEHMELSLGGPIETWFDDFDETPLASASIAQVHTATLKENGREVVLKVIRPDILPVIQADIKLMYRMAHIVARLLPEARLLRPVEVVREYEKTLLDELNMMREAANSIQLRRNFEDSDTLYVPEMFTDYSSTNLLVMERIYGIQVSDIDALIANGTNMKLLSENAVNIFFTQVFRDSFFHADMHPGNIFVSYENPETPQWIALDCGIVGTLNRDDKRYLAENLLAFFHRDYRKVAELHVDSGWVPQDTNIDEFEFAIRTVCEPIFEKPLCDISFGHVLLNLFNTARRFDMEVQPQLMLLQKTLLYVEGLGRQLYPQLDLWITAKPFLEDWMSRQVGPQAIVEAVKSKAPFWAEKLPELPELLYDSLRQGKVMNQRIDKLYDNFMESRRSQGLARFYFGIGATLVVCSAILFSNHVETIPVASAAMGVTFWLLGWRACRK

SEQ ID NO: 17505 - protein, 599 aa, Oryza sativa (japonica cultivar-group)
MERCQRRRWIGPAINVGREPPSSTAHLRPAPRKAQRTAKATAVATGDPDSGQLLHSPPCQCDASKSIQSNPIHDPIWLLDSLLFLDRYPSDPTMDNVSSPCCYAVCSYRKAKEQNKKSTTLIPFRCRRIDRFSIRLSGTGIMAAVEAEKVVAELRERCATPASLLRDVAAAMAGEMGAGLEKEGGSRVKMLLSYVDKLPTGREDGLFYGLDLGGTNFRVLKVHLGGSKKHVVNSESREVSIPPHLMSGTSQELFGFIAGELGKFVAEEEEGTDMPNGKKKELGFTFSFPVRQRSVASGTLVKWTKAFSIDDAVGEDVVAELQTAMVKQGLDMHVAALINDAVGTLAGARYYDEDVVAGVIFGTGTNAAYVEKANAIPKWEGELPNSGDMVINMEWGNFYSSHLPVTEYDEALDKESLNPGEQIYEKLTSGMYLGEIVRRVLLKLSLQSGIFGSIDNSKLKTCFHLRTPHISAMHHDETPDLKIVAEKLHQILQITHTSLEIRKMVVEICDIVARRAARLAAAGVAGILMKLGRNGGINNQRSVIAIDGGLFEHYTKFRECLESTLGELLGEEASKSVAVKHANDGSGIGAALIAASQSR

SEQ ID NO: 17506 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLISYISKVDAQ

SEQ ID NO: 17507 - protein, 274 aa, Arabidopsis thaliana
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKFHDERNLRFGRVKHRCSACRFGFGNGKECSCNNVKCQTEDSSSSSYSSTDISSSIGYDFLGLNNTRVLDFSTLEMK

SEQ ID NO: 17508 - protein, 494 aa, Pseudomonas aeruginosa PAO1
MIDLNPIQPICIAGEWRAGGGDLYESLYPATGEAVARLHAASLEDVEEAMAGAHRAFRESGWAQRKPHERATVLYRIAALIRERSEELAQLQRLDNGKPIRETRNLVASAAATFQFFAAACETLEESITPSRGDFVSMSVYEPMGVVVAITPWNSPIASEAQKLAPALAAGNAVVVKPAEITPLAALALARICDEAGLPRGLVSVLPGKGALIGDALTRHPLARRVSFTGGTRTGKHIARIAADKMMPVSLELGGKSPTMVLADADLDHAVAGVLYGIFSSSGESCIAGSRLFVASERYDEFMERLATGAAALRVGDPADERTQMGPLISARHRESVERYVEMGVAEGGRLRTGGLRPHGGAFDRGYFYTPTIIEGLTNGARLCREEVFGPVLVAMPFASEEALIEEANDSCYALAAGIWTRDFQRAWRLGRAVQAGTVWINTYKQFSISTPFGGWRDSGLGREKGRLGILQYMEQKSLYWGLNEQPLAWAGSH

SEQ ID NO: 17509 - protein, 188 aa, Sorghum bicolor
MGRSPCCEKAHTNKGAWTKEEDQRLVAYIKAHGEGCWRSLPKAAGLLRCGKSCRLRWINYLRPDLKRGNFTQEEDELIIKLHQILGNKWSLIAGRLPGRTDNEIKNYWNTPIQSASSSPAASTHGRTSRRVQAPLLPPPAPPLSPPRQASHSPAWRRQGGGGWCGPTGCSLRDKQAVTMTARSGSFRA

SEQ ID NO: 17510 - protein, 497 aa, Oryza sativa
MATCLDSLGPLLGGAANSTDAANYICNRFTDTSSAVDATYLLFSAYLVFAMQLGFAMLCAGSVRAKNSMNIMLTNVFDAAAGALFYYLFGFASRRTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALNHAVRQEMADGALERDRRLQRSPRRVRAITAGCSVVDPWASVICGFVSAWVLIGCNKLALMLKFDDPLEATQLHGGCGAWGIIFTALFARREYVELIYGVPGRPYGLFMGGGGRLLAAHIVQILVIVGWVSATMGTLFYVLHRFGLLRVSPATEMEGMDPTCHGGFGYVDEDEGERRVRAKSAAETARVEPRKSPEQAAAGQFV

SEQ ID NO: 17511 - protein, 334 aa, Streptomyces globisporus
MLGDEDGKAAELWSMANLGTPMAVRVAATLRIADHITAGAHTAGEIAEAAAVHEESLDRLLRYLTVRGLLDRDGLGRYTLTPLGRPLCEDHPAGVRAWFDMEGAGRGELSFVDLLHSVRTGKAAFPLRYGRPFWEDLAEDPRRAESFNRLLGQDVATRAPAVVAGFDWASTGHVIDLGGGDGSLLTALLTACPSLRGTVLDLPEAVQRAKESFAVSGLDDRANAVAGSFFDALPAGAGAYVLSLVLHDWDDEASVAILRRCAEAAGQTGSVFVIESTGSAGDAPHTGMDLRMLCIYGAKERRVEEFEELAGRAGLRVVAVHPAGPSAIIQMSAV

SEQ ID NO: 17512 - protein, 159 aa, Frankia sp. FE14
ITKEQYSRDPRNIAKKAETYLRGTGIADTAYFGPEAEFYIFDDVRYDYSPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 17513 - protein, 256 aa, Zea mays
MKPPASSTATSYLLLAPLAILLLVFVLPSLRPWSRVGSDSDGLGILCARRTGGFVDVAADAPAPPPGQTTRAAEFSLLVGVLTVPGRRERRDIVRTAYALQPAAEGARVDVRFVFCRVTDPVDAALLAVEARRHGDVLVLDGCAENMNDGKTYAYLSSVPRLFAAEPYDYVMKADDDTYLRVAALAGELRGKPRPRRPMPFMHGMGYVVSWDVAAWVAGAREILERNDTLGPEDLMVGKWLNLAGRGRNRYDLKPR

SEQ ID NO: 17514 - protein, 537 aa, Zea mays
MALEKLQVLHALDVADTQRYHVRAVVIAGMGFFADAYDLFCITLVTKLLGRIYYHVPGREEPGRLPPRLEAAINGVTFCGMIVGQLLFGWLGDKVGRKKFYGKTIMLMIMGSFLSGLSFGNSADGVMATLCFFRFWLGVGIGGDYPLSATIMSEYANKRTRGSFVAAVFAMEGFGVLAGCIVTLVVSATFQARFSAPAYEEDPAASTPPQADYAWRIVLMVGAIPACFTYHWRMRMPETARYTALVARDADKAARDMSRVLQVDITGEPDKVENITRDRGDYGAFSRRFARRHGAHLAGAVACWFVLDVVFYSQNILQEGIFSDVNWVPRARTMSALEETYRVGRAHAIIALCGTLPGYWFTIAFVDVVGRKAIQFLGFAMMMGFMLLIAAFYDSLISPGRRIWLVLMYTFTFFFANFGPNSTTFILPAEIFPAHLRTTCHGISAAAGKVGAIVGTFGFMYAAQKADGSEAAETGYPSGIGVRASLFVLAASNALGILFTCFLPEPKGRSLEEVCGEGAEPTIRDDTDVGDSKILPL

SEQ ID NO: 17515 - protein, 367 aa, Emericella nidulans
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQRIASAYPGLFIQKHVHVTGSAVGNRNEAIETMEFAARGVIKAHFREEKMEALTEIFKEMEEGKLQGRVVLDLS

SEQ ID NO: 17516 - protein, 537 aa, Saccharomyces cerevisiae
MTEDNIAPITSVKRLVTDKCTYKDNELLTKYSYENAVVTKTASGRFDVTPTVQDYVFKLDFEKKPEKTRNYAHWVRWLQQWLTLWPRYWRISTMWSFQTKAKGVKQPNYFGSMTQCSTLKLGIDAEGNDVYAPFNSLLPMVSPKHFVVSGWDINNADLYEAMQRSQVLEYDLQQRLKAKMSLVKPLPSIYYPDFIAANQDERANQCINLDEKGNVTTRGKWTHLQRIRRDIQNFKEENALDKVIVLWTANTERYVEVSPGVNDTMENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYMKPVGDSKVAMDEYYSELMLGGHNRISIHNVCEDSLLATALIIDLLVMTEFCTRVSYKKVDPVKEDAGKFENFYPVLTFLSYWLKAPLTRPGFHPVNGLNKQRTALENFLRLLIGLPSQNELRFEERLL

SEQ ID NO: 17517 - protein, 153 aa, Zea mays
  unsure (1)..(153): unsure at all Xaa locations
ITMDPTKVRPSSSHDTTVTTTNAGAPGLNEHQAXLTVGPPRPILVEDYPXEPKRGQFPAKHPEKPVAHRGAPPKVFLKAHKRSPLKGANFCGAPVGKPRKLAFPPXEHQRGSPQKNPTPPGFPQKLSPPPEKLNPLGKKNSPVFFSREGLISP

SEQ ID NO: 17518 - protein, 227 aa, Glycine max
GSRPLLTRWPFNKLIREKALQVTMKHIHYEDETSRYITIGCVEKVLCMLACWVEDPNGDAFKKHLARIPDYLWVSEDGMTMQSFGSQEWDAGFAVQAFLATNLIEEIGPTLAKGHDFIKKSQVKDNPLGDFKSMYRHISKGSWTFSDQDHGWQVSDCTAESLKCCLLLSMLPPEIVGEKMEPERLYDSVNVLLSLQSKKGGLAAWELAGAQEWLELLNPTEFFADIV

SEQ ID NO: 17519 - protein, 548 aa, Streptomyces coelicolor A3(2)
MAQVAMVMNLDKCIGCHTCSVTCKQTWTNRTGTEYVWFNNVETRPGQGYPRGHEDQEKWKGGWHLKGGRLVPRTGGRARRLARLFANPELPTLDDYYQPWTYDYENLTTAPLGDDIPTAPPRSAIDGRPTEITWGPNWDDDLGGGPAQLAADPLLARMSEQVRLDYERAFMFYLPRICEHCLNPSCVAVCPSGALYKRVEDGIVLVDQDRCRGWRMCVSGCPYKKVYFNHSTGKAEKCTFCYPRIEAGDPTVCSETCVGRLRYLGVMLYDPDKVGAAASVTDEKDLYEAQLGCFLDPDDPEVARAAQASGIPHDWVEAARRSPVHALITRYRVALPLHPEYRTMPMVWYVPPLSPVVDALTGTGHDGEDPAALFGAIDTLRIPLGYLAELFTAGDPGPVEAALCRLAAMRSHMRRVNLGEEQDPRIAEAVGLDEPGILELYRLLALAKYDERYVIPTAYTGSVPDPGGTGAGCSLDGVGGPGMMPEGAGGGPGFGEFDPEAFHAPPTAGSGTSSALRGRVNLLNWNGKGRPNGLFPRARGAVRTEPEL

SEQ ID NO: 17520 - protein, 307 aa, Heterocapsa triquetra
RIGRLVFRAAVSNPSISLKAVNDPFMDLKYMVYQLKYDSVHGRFAGTVEAKEADGKEFLVVNGTEIQIFHEKDPAAIPWGAAGADYICESTGVFTAQEKAELHIKGGAKKVIISAPPKDAVPIYVVGVNHLDYKASDTVVSNASCTTNCLAPLTKVVHEKFGIIEGLMTTVHAMTATQLTVDGPSRGGKDWRGGRCSSQNIIPSSTGAAKAVGKVIPSVNGKLTGMAFRVPTPDVSVVDLTVRLEKGAKYEEIVAAVKEAAAGPMAGVLDWTDEEVVSTDFTTCKASSIFDVGAGISLNDTFVKLVS

SEQ ID NO: 17521 - protein, 182 aa, Triticum aestivum
  unsure (1)..(182): unsure at all Xaa locations
PGLQXVXSLLXEXGVTVGGTNHXHXTKXLXDSIAAGNXPEWXXYIXTIDXXHXDRFDFXPLXVNKTWPEDVVPLXPVGXXVLNXNIDNFFSENEQLGFCPGXXVPGVXYXGDKLLQXKXFSYSGTXXXPPGGPTTCWWPXANXXKCSHHNNHYDRVKKXMHRDXEXDXFPPKXXXPQSKEAP

SEQ ID NO: 17522 - protein, 356 aa, Triticum aestivum
PGRPSRPNLACPRACRPAGLGLVGPGCRGLRDGGLLFSWAMHQVSNHLTTLQVMLPNITEGGSLSNMLENCMYCAMGLGLVGLDFRCLLPPIFENAVLNLFSKNMSTAVENFQVVLDSHRWVPMPSIGFVTNGAVDDTSDDVTPPSVLMEHPPLAVFVNGVSAAMNELKPCAPLSLKHVLAQEVVKGLQAVSDSLVRYNAMRMLRGNESSLFLSLCQAFIEVAYPYCAACFGRCYPNGGVLITECPSLLDAVSQLPIRSGSGISSIDRKSSGGIERRQSGGIERKQTGGIERKQLEGIERRQSGGIERRQSIESAGTAASENGLVTNGPEPEVTSDAGTTAEPAGADMQTDAPANA

SEQ ID NO: 17523 - protein, 411 aa, Halobacterium sp. NRC-1
MSRSPSLPDRPTLDVDPESTPAERLNALQDHYVDIVAVNGELQAQLDDVEARREELREEVNRLQRENETLKTASLYLATVEDLPEDGSAVIKQHGNNQEVLTELSPRLADTLEVGDRVAINDSFSVQRVLDDETDARAQAMEVDESPSVTYADIGGLDDQLREVREAVEDPLVNPEKFDAVGVEPPSGVLLHGPPGTGKTMLAKAVANQTDASFIKMAGSELVRKFIGEGSRLVRDLFELAEQKDPAIIFIDEIDAVAAKRTDSKTSGDAEVQRTMMQLLSEMDGFDERGDIRIIAATNRFDMLDSAILRPGRFDRLIEVPNPNPDARERILEIHAGEMNVADSVDFSDLAADTAEFSGAQLASLATEAGMFAIRDDRDEVHRQDFDDAYEKLVAEGDTESSGPRYPSYIQ

SEQ ID NO: 17524 - protein, 353 aa, Synechocystis sp. WH 8501
MKQPIHGGNLVWAAEQIGCPVSSILDFSASINPLGPPQSVLTAIQWALSTVQHYPDPNYTELRQALSEWHQLPSEWILPGNGAAELLTWAGCELARQKETYVMIPGFKDYWRGLQAFGANIIPVSFPWQSSDALKCVYNVGENDAGIIINNPHNPTGKLFTRETLLPLLERFSLVVVDEAFMDFVDPAQEESLISVIADYPNLIIVRSLTKFYSLPGLRLGYAIAHPQRIQKWKSWRDPWPVNSLAVQAAIAAIEDKEFTEQTREWLSVSRQQLLTGLSQIKGLNTFPNYVNFILVETEIPGPKLQQKLLQKYHILIRDCLNFETLGDRYFRIAVRTSEDNNKLLEGLSDICG

SEQ ID NO: 17525 - protein, 473 aa, Sarcodia ceylanica
  unsure (1)..(473): unsure at all Xaa locations
YESGVIPYAKMGYWDPDYVVKDTDILALFRVSPQPGVDAVEASAAVAGESSTATWTVVWTDLLTACDLYRAKAYKVDPVPKTSDQFLAYIAYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTIIIMIDLVIGYTAIQTMAVWARXNDMILHLHRAGNSTYSRQKIHGMNFRVICKWMRMAGVDHIHAGTVVGKLEGDPLMIRGFYNTLLKTHLAVNLPQGIFFEQDWASLRKVTPVASGGIHCGQMHQLLDYLGIDVALQFGGGTIGHPDGIQAGATANRVALESMVIARNEGRDYVAEGPQILQDAAKTCGPLQTALDLWKNITFNYTSTDTADFVETPTANV

SEQ ID NO: 17526 - protein, 420 aa, Shewanella oneidensis MR-1
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDDMRILGFEEKPQLPKHCPGNPEKCLASMGNYVFNTEFLFEQLKKDAQNAESDRDFGKDIIPSIIEKHKVFAYPFKSAFPNEQAYWRDVGTLDSFWLANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 17527 - protein, 199 aa, Yersinia aldovae
GSSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAF

SEQ ID NO: 17528 - protein, 247 aa, Gracilaria gracilis
CNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 17529 - protein, 200 aa, Glycine max
MAEQALEGSQPVDLTKHPSGIVPTLQNIVSTVSLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 17530 - protein, 469 aa, Porphyra fucicola
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 17531 - protein, 143 aa, Zea mays
MISAKRVAHLAKKWQRMAAQGRQRLTWGGAGAAAKQAGGCCASVASKGHCAVYTTDGARFEVPLACLGTAVFAELLHMSREEFGFAGGHGRILLPCDAMVMEYALCLLRRGASADLEKAFLSTMAMSCHSADHAAAPYVAACC

SEQ ID NO: 17532 - protein, 333 aa, Magnetococcus sp. MC-1
MSVTIGINGFGRMGRLVLRAGWNSPGIIWGPINETSTDAHGSAHLLQFDSVHGRWQHPCTAQQGEICIEDSRIPYHSVADIDAHHWSTCDLVIEATGKHHKQPHTLQRYFEQGVKKVLVAAPTEGALNLVYGVNDHLYQPQQHHLVTAASCTTNCLAPVIKVLHEKIGIVHGTMTTIHDITNTQTIVDKGHKDLRRARACGNSLIPTSTGSAKAITKIFPELTGKLNGVAVRVPLLNASLTDCVFEMAKPVTESAINTLFKEASESYLHGILGYEERPLVSVDFLNDPRSAIIDAPSTMVIDGTQLKVLAWYDNEWGYVNRLMDLALKIANTL

SEQ ID NO: 17533 - protein, 308 aa, Erwinia amylovora
MKKRIWVLGDAVVDLLPGQDNLLLKCPGGAPANVAVGIARLGGNSAFIGCVGDDPFGEFMQTTLQREGVDIGKMFRIDGQRTSTVLVSLDTEGERHFTFMVRPSADLFLRTDCLPSFAQGEGLHLCSIALSAEPSRGAALHAMHAIRQAGGWVSFDPNLRADLWPDADEMARSVAQAFELADIIKLSEDELVFLTGLAILEQGIDQFTARYQPALLLVTRGSQGVSVWQAGRLQHFAAPQVEVTDTTGAGDAFVAGLLAALVQETNPLQPQRLDFAVQQAQHSGAAATTAKGAMTALPYAKDLVRFSQ

SEQ ID NO: 17534 - protein, 855 aa, Azotobacter vinelandii
MVVVVAVAALFTGIWALYNLPVTAPDWPEQDLRLLASPPSAPGQNPQENRYPSDDEIRADLELLSRQTDSIRTYSVDGNLANVPRLAEELGLRVTLGIWISQDMERNEREIAKAIELAKSSRSVVRVVVGNEALFRSEITPEALIAYIDRVRAAVKVPVTTSEQWHIWQEYPELGRHVDLIAAHILPYWEFVPMEDSVQFTLDRARDLKKLFPRKPLLLSEVGWPSNGRTRGGAEATQIDQAIYLRTLVNTLNAQGYNYFVIEAFDQPWKIDDEGSVGAYWGVYNFERQPKFAFEGPVVAIPQWRLLAVGSVVLAVLALALLLIDGSALRQRGRTFLTFVAFACGSILVWIGYDYSQQYSTWFSLTVGFLLALGALGVFIVLLTEAHELAETVWTLKRRRPFPPVTADEAYRPKVSIHVPCYNEPPEMVKQTLDALSRLDYPDFEVLVIDNNTKDPAVWKPLEEHCARLGPRFRFFHVAPLAGFKGGALNYVLQYTAPDAEVVAVIDSDYCVERDWLKHMVPHFADPKIAVVQSPQDYRDDRESAFKKLCYAEYKGFFHIGMITRNDRDAIIQHGTMTMTRRSVLDELGWADWCITEDAELGLRVFEKGLSAAYSERSYGKGLMPDTFIDFKKQRFRWAYGAIQIMKRHTRSLLWGKESELTRGQRYHFLAGWLPWIADGLNIFFTLGALLWSAAMIIVPHRVDPPLLIFAIPPLALFFFKVGKILFLYRRAVGVNLKDAFYAAIAGLALSHTIAKAVLYGFFTSSIPFFRTPKMANNHGILVALAEAREEVVIMLVLWGAAAGIALVQGFPSNDVIFWVAVLLIQSLPYLAALIMALLSSQPKKVQEVPLVEAV

SEQ ID NO: 17535 - protein, 476 aa, Gracilariopsis lemaneiformis
  unsure (1)..(476): unsure at all Xaa locations
NERYESGVIPYAKMGYWDPDYVIKDTDVLALFRVTPQPGVDPVEASAAXAGESSTATWTVVWTDLLTACDLYRAKAYKVEAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRAVAATGEIKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNEKRDYVAEGLEILRDAAKTCGPLQTALDLWKDITFNYTSTDTADFVETPTANV

SEQ ID NO: 17536 - protein, 219 aa, Zea mays
MAGRRAEEEYDYLFKAVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNTRIMLVGNKTDLRHLRAVATDDARSFAEAEGLSYIETSALEATNVEEAFQLILGDIYRAVSKKPVASDEAGAGQGGVKEGKTIDVATGADAAAHKKQCCSA

SEQ ID NO: 17537 - protein, 488 aa, Photorhabdus luminescens
MTIINHWINGKNVSSKTYFETTNPATGEVLAEVAAGGQEEIDQAVAAAKEAFPKWADLPMKERARLMRRLGELIDENVPEIAAMETKDTGLPIHQTQNVLIPRASHNFNFFAEICQQMNGHTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTVTGRQIMKNAGLKKYSMELGGKSPVLIFEDADIERALDASLFTIFSINGERCTAGSRIFIQQSIYPEFIKRFAERANRLRVGDPQDPNTQIGALISKPHWEKVSGYIRLGIEEGATLLAGGPDKPIDLPAHLKEGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHHIPRWGI

SEQ ID NO: 17538 - protein, 648 aa, Oryza sativa (japonica cultivar-group)
MPQYQELPCGGQVLDIDTALKDGILGGGPELGDAAAGDGGKQPVELRKMMDELDAAGDGGGDEAVPAVFICPISLEPMVDPVTLCTGQTYESANISRWLALGHRTCPTTMQELWDVTPIPNTTLRQLIAAWFSRRYTRFKKRSADFHGRAAELVHALRGTAVPKRQPLKGQARVAALRELRSLAAAHQSVTKAIAEAGGVGLLTSLLGPFTSHAVGSEAVAILVSGVPLDADAKAALMQPAKVSLLVDMLNEGAVDTKINCVRLIRILMEEKGFRPDTVASLSLLVGVMRLVRDKRHPDGVAAGLELLNSICAVHKPARSLIVSIGAVPQLVELLPELPTECVEPALDILDALAAVPEGRIALKDCPRTITNAVRLLMRVSEACTRRALSMLWVVCRMAPEECAPAALDAGLGAKLLLVIQSGCGPELKQQASELLKLCTMNCTSTVFISKCKLTKTIHIQNAAYTQLIQWQAGGMYMQIDEDFGQLNKHSRLGGAAIYSGSPAVRRWHWLVYTPTLVVGLVAAAGHLSVTVRWALHDRGDEVGASGWLPPSGSGSGSGAWGGFIDLQSGNRSNETSEAFAASLASGSRPVCVRPKWPHLTGKTDHITRRRHASISPQLFSALVSRTPDARCFSQNSTNAFNFTLFMV

SEQ ID NO: 17539 - protein, 513 aa, Nitrobacter winogradskyi
MDIRAQVSMVFHLDKCIGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLINAPLADEQPTARAISMVTGKYMDTIEAGPNWDDDLGGSQVYANNDPNFDGASDEEMRQINEINSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPAAKIQAAQQSPVYQFVKKWGIALPLHPEFRTLPMLFYVPPLGPVLAKVENGVYNNISHEARLGPLMSSLERSRVSLRYMASLLSGGNEEVIRDVYKKLVAVRVYMRSRKVKDIPDEEVQRALSEGKTTAAEVEAIWRLTSMPTFEERFVVPPMERETAVDALFPQLDPVSHNYSIRRGAVGVGFHTDPARGP

SEQ ID NO: 17540 - protein, 154 aa, Glycine max
  unsure (1)..(154): unsure at all Xaa locations
TCVPWLLKLMISXSSQTNELYQLASVAFCLLVAWCSDKLGLSLELGSFAAGVMISTTDLGQHTLEQVEPIRNFFAALFLASIGMLIHVHFLWNHVDILLAVVILVIIIKTIVATSVVKGFGYNNKTSLLVRFDNSYYNYICLLITSYISLTEEP

SEQ ID NO: 17541 - protein, 510 aa, Zea mays
MFIESFRVESPHVRYGPMEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEVSPSTLYAIACVMEGVPFINGSPQNTFVPGLIDLAIKNNCLIGGDDFKSGQTKMKSVLVDFLVGAGIKPTSIVSYNHLGNNDGMNLSAPQAFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 17542 - protein, 215 aa, Glycine max
  unsure (1)..(215): unsure at all Xaa locations
PRVRFSLWGGGFLYGWGVIEGSGGXVIDLSSGIAGFTAAYWGXLWMGWSGFNGGAPYAANIDSSIAVLNTNICAATSLLVWTSLDVIFFGKPSVIGAVQGMMTGLVCITPGAGLVQSWAAIVMGXILSGSIPWVTMMILHKKSSLLQKVDDTLGVFHTHAVAGLLGGLLTGLLAEPQLCRLILPVTNSRGXAFYGGSGGIQLFKQLVAAWFNSWM

SEQ ID NO: 17543 - protein, 308 aa, Agrobacterium tumefaciens str. C58
MILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 17544 - protein, 474 aa, Bumilleriopsis filiformis
  unsure (1)..(474): unsure at all Xaa locations
RYESGVIPYAKMGYWDADYNVKHTDILALFRITPQPGVDPVEAAAAVAGESSTATWTVVWTDLLTACDIYRAKAYRVDPVPGTTDQFFAYISYQCELFEEGSIANLTASIIGNVFGFKAVKALRLEDMRIPFAYLKTFQGPATGLIVERERMTKFGRPLLGATVKPKLGLSGKNYGRVVYEGLRGGLDFLKDDENLNSQPFMRWRERFLYCVEGINRASAASGEVKGSYLNVTAGTMEDMYERAEYAKTVGSIIVMIDLVIGYTAIQSMGVWARKNDMILHLHRAGNSTYARQKNHGINFRVICKWMRMGGVDHIHAGTVVGKLEGDPLMVKGFYNVLLNCHTEVNLPQGLFFEMDWACLRKTVPVASGGIHCGQMHQLLYYLGXXXXXXXGGGXXGHPDGIQAGATANRVALEAMVLARNEGRDYLNEGPQILRDAAKMCGPLKTALDLWKDITFDYTSTDTPDFVETATESK

SEQ ID NO: 17545 - protein, 310 aa, Bacillus anthracis str. A2012
MAENQDKNSLEEQDVKRETLTTRQGHPVKDNQNIRTIGNRGPATLENYHFIEKISHFDREEVPERVVHARGAGAFGYFETYGKVGDEPAEKYTRAKVFSGAGKKTPLMVRFSTVAGAKDSPETARDPRGFAVKMYTEDGNWDLVGNNLKIFFIRDAMKFPDMIHAFKVDPVSNVSNPQRMFDFVSRTPEATHMITFLFSPWGIPATYRHMQGSGVNTYKWVNEKGEAVLVKYHWEPKQGIRNLTQEDANSIQAMNVSHATQDLYEAIERKDYPEWELFVQIMEDGYHPELDFDPLMIRSFGQRSSSHGYQ

SEQ ID NO: 17546 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 17547 - protein, 1154 aa, ASPERGILLUS NIDULANS FGSC A4
MAATIPFLTLSIGRDLRRSALRHRSRMVAARLFATSSHPKLTTTATATTTQNLTPRANDEVARLAASRRRPLTLADLLKYGRPPLSKEALLASANFTLSLLPARLASRIEALRNLPFIVVANPHVSKIYGNYVHSLSTLLPWQKRQVTTLEEENQFAEVLADLVHTHSNTIPILARGFLECRKYIDPAEVTRFLDTHLRARIGTRLIAEQHLALHFASRPAGDGSAEGREQPRKDAPPSNYIGVIDTALQPARIVRSCEEFVGEICELKYGVRPRLEIHGQPDATFAHVPVHVEYILTELLKNAFRAVIESGNEQEPIEVTIAAAPDVPGNHLQAHEPVTNGKPADALDTGAQSDSDVGFHVDTVVGTADANESIKFSTPSSQSITLRIRDRGGGISPDVLPQIWSYSFTTFSDLDMGEAGGIDALNTISSNSGQLSSIAGLGYGLPLSRAYAEYFGGSIAVQTLWGWGTDVYLTLNGVGKSPISRKHLSSGCPKHCVEIYPAAELVRALKLSVKRALLRSLSALGVGDVADIGVRGSSIKRVSLARDTRLFPPHSLWVYTASFAFFEALWEAGVTHCFVNLGSDHPSILEAMVKGQKEKPNEFPKIVTCPNEMVALSMADGYARLTGKPQCVIVHVDVGTQGLGAAIHNASCGRAPVLIFAGLSPFTIEGEMRGSRTEYIHWIQDVPDQKQIVSQYCRYSADIRSGKNIKQMVHRALKFATSDPQGPVYLVGAREVMEEEIEPYAVSPYGWRGVAPPALPAEGVELIAQELASAKEPLVIVGYSGRTARGVEQLVKLADTYKGIRVLDTGGSDMCFPADHPASLGMRFGIHEAIKTADFILVADCDVPWIPTQCSPSDSAKIIHVDVDPLKQQMPVFYIPAMATFRAESATAFEQVNAYVESNTELKQFIASDANTVLGQSREEAFRTTRQAINELAVTPAGGPDAALNASYLLSEIRKTLPLDTIWAVESVTLTPIVADQIAATLPNSWINCGGGGLGWSGGAALGIKLATDAQAGGGNKGKFVCQIVGDGTYLFSVPGSVYWIARRYNIPVLTIVLNNKGWNAPRRSMLLVHPNGDGSKATNEELNISFAPTPDYAGIARAASGGHIWAGVAGSVGELGRLLPEAVESVKNGVGAVLEAQLDGTEGKYVRK

SEQ ID NO: 17548 - protein, 160 aa, Zea mays
  unsure (1)..(160): unsure at all Xaa locations
MISLTKLLSSALHGYHSCSIRRFSWFAALGEHQFAVANFSKFVTRLIRNIARFGVASVAGKLYVIGGGSDRVDPLTGDHDRIFASNEVWSYDPLHRVWSQRAPMLVARAMFACCALDGKIIVAGGLTNCRKSISKAEIYDPXAGIWEPLPDLRLAHSSAC

SEQ ID NO: 17549 - protein, 354 aa, Neisseria meningitidis Z2491
MALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 17550 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKAYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 17551 - protein, 447 aa, Oenococcus oeni MCW
MTKLTKEAIKKSVKDEGVDFLRVMFTDVFGMIKNVEIPVSELDTVLDDNLLFDGSSIDGFVRIEESDMYLYPDLDTFRILPDSMTGEHDGKVAMIVANVYTSDRLPFEGDPRNNLIRVLAEMRKDGFSDFNVGTEPEFFLFKLGEDGKPTMKLNDNGGYFDLAPLDLGEHVRREIVLTLEKMGFEVEAAHHEVAPGQHEVDFRYADAVTAADHIQLFKLIVKTVARKYGYYATFMPKPIAGINGNGMHTNMSLSKDGKNAFDDPTDKLGLSKVAYHFLGGLLDHAQNFVAITNPTVNSFKRLTPGFEAPVYIAWSASNRSPMVRVPASRGASTRLELRMVDPTANPYLAFAVVLNSGLDGVEKETTPEHSVDRNIFLMDANERKKAGIKDLPDTLLTAVDNLSKDEVVISAISKRIADTFVEAKKLEYQSYRASVSKWEIKQYLQTF

SEQ ID NO: 17552 - protein, 114 aa, Klebsiella pneumoniae
SLYDIAPVTPGVAVDLSHIPTDVKIKGFSGEDATPALEGADVVLISAGVARKPGMDRSDLFNVNAGIVKNLVQQIAKNCPQACIGVITNPVNTTVAIAAEVLKKAGVYDKNKLF

SEQ ID NO: 17553 - protein, 317 aa, Capsicum annuum
KVGINGFGRIGRLVARVILQRDDVELVAVNDPFITVDYMTYMFKYDSVHGQWKNNEVKVKDEKTLLFGEKPVTVYGIRNPEEIPWAEAGAEYVVESTGVFTDKDKTAAHLKGGAKKVVISAPSKDAPMFVVGVNEKEYKPDLNIVSNASCTTNCLAPLAKVIHDRFGIVEGLMTTVHSITATQKTVDGPSAKDWRGGRAASFNIIPSSTGAAKAVGKVLPSLNGKLTGMSFRVPTVDVSVVDLTVRLEKEATYDEIKAAIKEESEGKLKGIVGYTEDDVVSTDFIGDNRSSIFDAKAGIALSKTFVKLVSWYDNEWG

SEQ ID NO: 17554 - protein, 143 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 17555 - protein, 160 aa, Zea mays
  unsure (1)..(160): unsure at all Xaa locations
TERGYQGTPGCIPFSILRLGTSEPSDGSXVVTXYGXNGASAAXAVSXXXSXTFSVXVXLTQMLRGXXIMXVXTPEXARLAXEAXAXAVXTLEXAXPAXIRAXGXVSRXSDPGLIXDIKRAVTIPXMFQVRIEHFXXXQILXAVGVDYLDESEVLTPADDA

SEQ ID NO: 17556 - protein, 392 aa, Burkholderia fungorum
MKYSNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIAAFVRALPAR

SEQ ID NO: 17557 - protein, 333 aa, Haemophilus influenzae Rd
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 17558 - protein, 585 aa, Lactobacillus plantarum
TNILAGAAVIKVLEAWGVDHLYGIPGGSINSIMDALSAERDRIHYIQVRHEEVGAMAAAADAKLTGKIGVCFGSAGPGGTHLMNGLYDAREDHVPVLALIGQFGTTGMNMDTFQEMNENPIYADVADYNVTAVNAATLPHVIDEAIRRAYAHQGVAVVQIPVDLPWQQISAEDWYASANNYQTPLLPEPDVQAVTRLTQTLLAAERPLIYYGIGARKAGKELEQLSKTLKIPLMSTYPAKGIVADRYPAYLGSANRVAQKPANEALAQADVVLFVGNNYPFAEVSKAFKNTRYFLQIDIDPAKLGKRHKTDIAVLADAQKTLAAILAQVSERESTPWWQANLANVKNWRAYLASLEDKQEGPLQAYQVLRAVNKIAEPDAIYSIDVGDINLNANRHLKLTPSNRHITSNLFATMGVGIPGAIAAKLNYPERQVFNLAGDGGASMTMQDLVTQVQYHLPVINVVFTNCQYGFIKDEQEDTNQNDFIGVEFNDIDFSKIADGVHMQAFRVNKIEQLPDVFEQAKAIAQHEPVLIDAVITGDRPLPAEKLRLDSAMSSAADIEAFKQRYEAQDLQPLSTYLKQFGLDD

SEQ ID NO: 17559 - protein, 310 aa, Caulobacter crescentus CB15
MPSSTHLYSDRRFVVGVALFCCLLWGSAFPAVKAGYALLHVAKSDTAAQMLFAGWRFFAAGLILLVLAVASRRPIAVPRAQIGRLMGLGVFQTTLQYVFFYIGLAHATGVKSSIMNATGAFFGVVLAHFLFPNDKLTPRKVIGCLLGFAGVLAVNLGGKGFDFEFSLLGEGFVVAAAFVLAAGSIWGRAISQTCDPMVMTGWQLAIGGGVLLAIGAVAGGHLEAFDARSLALLAYMAGLSAAAFALWSLLLKHNPVGLLAVFNFLIPVFGVLLSALFLHEPVLAWKNAAALALVCGGIVLVTGRARSRQG

SEQ ID NO: 17560 - protein, 497 aa, Oryza sativa; identical to SEQ ID NO: 13587

SEQ ID NO: 17561 - protein, 468 aa, Medicago sativa
MNMMRRLKSIASGRTSISSDPGGDSNSKRVKLDQETEKVYEGINSLGRNDREQCVDASKEASVGTSNEVSTETKTEKKSGFDELPKELHEMKIRDEKSKNNNEKDIEATTVSGNGTETGQIITTTIAGRDGQPKQTISYMAERVVGTGSFGVVFQAKCLETNEAVAIKKVLQDKRYKNRELQVMRMVDHPNIVKLKHCFYSTTEKDELYLNLVLEFVPETVYKVSKNYIRIHQHMPIIHVQLYTYQILRGLNYLHEVIGVCHRDIKPQNLLVNPQTRQLKICDFGSAKMLVPGEPNISYICSRYYRAPELIFGATEYTTAIDMWSVGCVLAELLLGQAMFLGESGVDQLVEIIKVLGTPTREEIRCMNPNYNEFKFPQIKAHPWHKLFHKRMPSEAVDLVSRLLQYSPHLRCTALAACAHPFFNDLRDPNASLPNGQPLPPLFNFTPQELVNAPEDLRQRLIPEHARS

SEQ ID NO: 17562 - protein, 410 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 17563 - protein, 353 aa, Escherichia coli CFT073
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 17564 - protein, 565 aa, GIBBERELLA ZEAE PH-1
MARAMGWHKPENFAGSSIRAILVGLFVSSGGLLFGYDVGVINGILAMDVFQNDFATDQTCRDENDHIDLCPIDSSLIVAILSGGAVVGSILAAPAGDSIGRRKTLFLAVVTFCIGAIFQVCAQATPMLLVGRALAGVAVGATSVLVPLYQSETAPKWIRGSIICAYQLSITVGILGATIINVITSGMNSAAAYRIPLGLQLVPGVILAFGIMLLPETPRFLVKKGRNDDAGISLSRFRRLDITHPALVNELQEIIANHQYEMTLGQDTYRALFTSNSSLGHRTLTGCVLQMLQQLTGINFVMYYGTTFFSRSGVSNPFIINLVMIIVNCVCTIPGLIVIESWGRRKLLMAGALGMAVCQFIIGAVSTANEKSSQDLGNASNMALIVCCAINVFFYASSWGPVTWVVTSEIFPLKLRAKAMSVSTTANWLLNFAVAYAPPFILGRRADAFGLKIFFIWGTFCILAIVFVWFMVYETSRMTLEQIDEMYERVSHAWESPGFNPSWSFQEMHNTGWAANGQAELQSATSTSNNISSSNTEDGGNDRHSIHSNAPPNSATPIANVDFSY

SEQ ID NO: 17565 - protein, 277 aa, Citrobacter freundii
EIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDN

SEQ ID NO: 17566 - protein, 468 aa, Salmonella typhimurium LT2
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVYMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 17567 - protein, 144 aa, Glycine max
MSGLIEGLPDAVAIRCLARVPFYLHPVLELVSRSWQAAICSPELFKARQEVGSTEDLLCVCAFDPENLWQLYDPMQDLWITLPVLPSKIRHLSNFGAVSTAGKLFVIGGGSDAVDPLTGDQDGCFATDEVWSYDPVVRQWAPLA

SEQ ID NO: 17568 - protein, 133 aa, Oryza sativa
LELLKTAIEKAGYTGMVVIGMDVAASEFYSDKDQTYDLNSKEENHDGSQKISGDSLKNVYKCFGSEYPIVAIEDPFDQDDWVHYAKMTEEIGEHVQIVGDDLLVTNPTRVAMAITEKSCSALLLKDNQIGSVT

SEQ ID NO: 17569 - protein, 363 aa, Euglena gracilis
PDFPKDLKGVLDGNQVRTLFDFAQKKGFAIPAVNCTSSSTVNVVLERARDTHNPVIIQVSQGGAAFYCGKGVKDEKLIASVDGSVALAHHVRAVAHTMAPVVVHSDHCAKKLLPWFDGMLDADGEIFCEHGVPLFSSHMLDLSEENDEEDIGTCVKYFTRMAKLNLWLEMEIGMTGGVEDGVDNSGVANDKLYTSSEQVFAVHKALGASSPNFSIAAAFGNVHGVYKPGNVKLQPNLLKEHQDYARKQLSSSEDHPLYLWFHGPSGSTDAEIHEAVRNGVVKMNLDTDMQWAYWDGLRQFEAKKHDYLQGQIGNPEGPDKPNKNYYDPRKWIREAELGMLARVKVAFKAVELPGGLKEFIGIP

SEQ ID NO: 17570 - protein, 474 aa, Apedinella radians
  unsure (1)..(474): unsure at all Xaa locations
RYESGVIPYAKMGYWDATYSVKATDVLALFRITPQPGVDPVEATAAVAGESSTATWTVVWTDLLTACDIYRAKAYRVDPVPNAADQFFGYIAYECELFEEGSLANLTASIIGNVFGFRTVKALRLEDMRIPYDSLKTFQGPATGVIXXXXXXXXFGRPLLGATVKPKLGLSGRNYGRVVYEGLKGGLDFLKDDENINSQPFMRWRERFLSYKEGITRASAATGEVKGSYLNVTAATMEEVIERAEYEKEIGTIIIMIDLVMGYTAIQSIALWARKNDMILHLHRAGNSTYARQKNHGINFRVICKWMRMAGVDHIHAGTVVGKLEGDPLMVKGFYNTLLDVKTDINLPQGLFFAQDWASLRKCMPVASGGIHCGQLHMLLNYLGDXVVLQFGGGTIGHPDGIQAGATANRVALEAMVMARNEGRDYLAEGPQILMDAARMCGPLQTALDLWKGISFNYTSTDTADFAETPTVNV

SEQ ID NO: 17571 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 17572 - protein, 220 aa, Arabidopsis thaliana
MSSIASGTVSTTRSTLCFRKIPKSATVLSMLHRSSSSSPRMLLLLSSSSANSAKLLNSNNGLLISSSPKPFRPVMQWQDVTVKMVVDAPASVAYKLYADREMFPKWMPFLSSVEAMEGSPDLSRYLVKLESFGQNIEYHFLAKNLQPIPDRKIHWRSIEGFENRGSVRFFPRGPSSCLVEISFSYEVPNAFAPVAFAMKPFMEKIIRGGLERFAAFVKTI

SEQ ID NO: 17573 - protein, 314 aa, Archaeoglobus fulgidus DSM 4304
MDVTIALVAALAIAFAIGSNDTCNSFGICVGCGLLTMKRAAYILFLLVFAGMLFGSGRIMDTVGREMVELNEIVVSVSLIISSAAIVAANYLRTPVSSHQAIVMSLIGSAFALGNRIDVSTVAKIVLSWVISPFGALLLSIVFYWIMERTLAKLPALRVERVLRVLLFIGATVIGFNTGANELATALAPIVMFGVMNVFEAALLGSAMLFLGAWIVSVRVAEVVGKGITALDPFTGFAAQFAAGITVLLFTLIGMPVSTTYCTVGAVTGVGLYKSVRGVKFAFLKRIVASWILTPFTAFTLSFILTLLLSQQAF

SEQ ID NO: 17574 - protein, 87 aa, Oryza sativa
  unsure (1)..(87): unsure at all Xaa locations
HRPSSSINGPLWITNSGAPEWNNNNSITIDSRGPILLEXYNLDAKLATFYRERIPDRMAYACRDQXARAIYEVTQXITHLTCADFLR

SEQ ID NO: 17575 - protein, 118 aa, Citrus x paradisi
MNQRFCCLIVLFLSVVPLLAAGDRKGALVGGWKPIEDPKEKHVMEIGQFAVTEYNKQSKSALKFESVEKGETQVVSGTNYRLILVVKDGPSTKKFEAVVWEKPWEHFKSLTSFKPMVK

SEQ ID NO: 17576 - protein, 277 aa, Glycine max
LTNMNPSCRFSSTKHSPFLHNSHTHLSKTTSPYVFLGHSHSQKPFLLSPPITTKPYPFNNILRFRNIKLSYPFATLSSFAEGEQQENQKEGTETPPSNDELGGIAKAFNISSRTASAISICMALAVLTFPLFMTSLGQGMVLKNKVLSYATLLFGFYMAWNIGANDVANAMGTSVGSGALTLRQAVLTAAVLEFSGALMMGTHVTSTMQKGILVANVFNGKDSLLFAGLLSSLAAAGTWLQFASYYGWPVSTTHCIVGAMVGFGLAYGGAEAVFWGS

SEQ ID NO: 17577 - protein, 358 aa, Photobacterium profundum
MSKIFDFVKPGVISGDDVQKVFAVAKENKFALPAVNVVNTDTINGVLEAASKVKAPVVVQFSNGGAGFFAGKGVKLEGQGAQILGAVAGAKYVHAVAASYGVPVILHTDHAAKKLLPWIDGLLDAGEEFFAQTGKPLFSSHMIDLSEETLEENIETCGKYLERMAKMGMTLEIELGCTGGEEDGVDNSDMDASELYTSPEDVAYAYEKLNAISPRFTIAASFGNVHGVYQAGNVVLTPTILRDSQAYCAEKFGIASDALNFVFHGGSGSSEAEIQESIGYGVIKMNIDTDTQWASWDGVRTYEAENRDFLQGQIGNPTGESAPNKKYYDPRVWLRAGQASMVKRLEKAFSDLNAIDVL

SEQ ID NO: 17578 - protein, 182 aa, Pseudomonas putida KT2440
MHSDAFDLKALIRPVVDFPKPGVIFRDITPLFQSPRGLRYVADQFIERYVEAEFSHIGAMDARGFLIGSIIAHQLNKPLILFRKQGKLPADVLSEGYQTEYGEAFLEVHADSLCEGDSVLIFDDLIATGGTLLAAANLVRRTGAQVFEAAAIIDLPELDGSRRLQAAGVPTFCLTEFSLSEY

SEQ ID NO: 17579 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 17580 - protein, 359 aa, Triticum aestivum
  unsure (1)..(359): unsure at all Xaa locations
MSAAYDRAAELRALDATFAGVRGLVASGVTRVPRIFXSPTTPTKAPQEPTGGRQEPAAIPVIDLGCSNRAAVVAAVGRAAAEWGFFQVTGHGVPPEVGTAAVEAARAFHESPGGEGTDKARLYTREPARAVKYNCNFDLHQSKVANWRDTLYLRVEPHPPDAGDMPESCRRDVFFDYAEHVRNLRDTLFALLSEALGLHPNHLADMGCNQGQMILCHYYPPCPEPELAIGTTRHSDSGFLTVLLQDGVGGLQVLHENQWVDITPTPGAFIVNVGDLLQMISNDRFRSVEHRVIANNDAPRVSIACFPSNPSSERIYGPIKELLSGKNPPLYRETLARDYVAHYYSVGLGPKMAINDFRL

SEQ ID NO: 17581 - protein, 148 aa, Oryza sativa
MKVKILQWHSVASWTWDAQDETCGICRMAFDGCCPDCKFPGDDCPLIWGSCNHAFHLHCILKKTFLELRNVVFKYYVLIFSANADGHNLLSETGRKLHLVHVVLSRVQAPGSLATVGKSRDLPFYMAPNFRLLEFLGSFLLGYNVNSV

SEQ ID NO: 17582 - protein, 413 aa, Deinococcus radiodurans
MKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 17583 - protein, 490 aa, Pseudomonas putida KT2440
MARFGTQKLYIDGAYVDAGSDATFEAINPATGEVLAHVQRATEADVEKAVESAERGQKVWAAMTAMQRSRILRRAVDILRERNDELAMLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFQHMESVLGYIAKGKEEGARVLCGGERLTAGDFAKGAFVAPTVFTDCTDDMTIVKEEIFGPVMSILTYETEEEVIRRANDTDYGLAAGVCTNDITRAHRIIHKLEAGICWINAWGESPAEMPVGGYKQSGVGRENGVSSLAQYTRIKSVQVELGGYNSVF

SEQ ID NO: 17584 - protein, 307 aa, Bradyrhizobium japonicum USDA 110
MSGAMTDLTKPATADGHLKRPAISFEFFPPKTEEMERNLWETINRLAPLDPKFVSVTYGAGGSTRERTHSTIARILKETALLPAAHLTCVGASRGEIDEIVDRYHEVGVRHIVGLRGDPPGGIGTPYSSHPDGYQSSADLVAGIKKRHGDIEVSVSAYPEKHPEARDFDADIDTLKAKVDAGATRAITQVFFDNDLYFRYLDRVRARGINIPVVPGIMPMHNFKQARAFVTRAGTSVPDWLAEKFEGLDDDAETRKLVAATVAAGQVQKLAKHGVDTFHFYTMNRADLVFAISHLLGIRAKSAQKAA

SEQ ID NO: 17585 - protein, 197 aa, Ralstonia solanacearum
MTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 17586 - protein, 175 aa, Glycine max
MQSQVVCNGCRSLLLYPRGATNVCCALCNTITSVPPPGMEMSQLYCGGCRTLLMYTRGATSVRCSYCHTVNLVPPASNQVAHVHCGNCRTTLMYPYGAPSVKCALCHFITNTNNGRLPIPVHRPNGTNNAGTLPSTSTSMPQSQSQTVVVENPMSVDSSGKLVSNVVVGVTTDKK

SEQ ID NO: 17587 - protein, 327 aa, Triticum aestivum
  unsure (1)..(327): unsure at all Xaa locations
QENWRILDFFSHHPESLHMFTFLFDDIGVPADYRHMDGSGVNTYTLVNRAGKAHYVKFHWKPTCGVKSLLEEEAVTVGGTNHSHATKDLTDSIAAGNYPEWTFYIQTIDPDHEDRFDFDPLDVTKTWPEDVVPLQPVGRLVLNRNIDNFFAENEQLAFCPGIIVXPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 17588 - protein, 429 aa, Arthrobacter nicotinovorans
MQRQEEQLTGLAGNRSGLGTIGKSLPEHEHRSVSVHRQAIRDVLFPLLTPPRVERIPLMQAMGRGLAETIHAPTNLPPFTNSQMDGYAVRSRDTAGGQGGLRVAAPIPAGAVPAPLVGGTAAPIMTGALIPDGADAVVPVERAVPNHFPPPGLDRTVRLPEIAAGTYIRSAGSDIATGECALSAGTVLGPRQLGLLAALGITEVVVNQKLTVLLATTGDEVLEPGEKLALGKIYDANNTLLQSSMLQAGLNVIRAGIVKDEPGALSKLLRSHTAHVDLIVTSGGVSAGAYEPVRQAMIDHDVEFSHVAIQPGGPQGVGTFEGIPVLAFPGNPVSCFVSFEMFLRPLLSEMFAAPTPRLSFRAPLSHPLTSPPKKHQVRRGVLSADGTIRLEGGEGSHLLGALARSNVLVHIPEGISELAKGSEVEVWAV

SEQ ID NO: 17589 - protein, 504 aa, Glomerella cingulata
MGSDEKSPSTYRYDETPTYTTSNGAPVANPQHWQRPGPSGPLLLQDFHLIDLLAHFDRERIPERVVHAKGAGAYGEFEVTHDISDIASIDMLKEVGKKTKAVVRFSTVGGEKGSADSARDPRGFASKFYTDEGNWDWVYNNTPIFFIRDPSLFPVFIHTQKRHPRTNLKDATMMWDYWSTHQECVHQLMHLFSDRGTPYSYRHMNGYSGHTHKWTKPDGSFVYVQIHLKTDQGNKTFTNEEAAKLASENPDWHTQDLFESIQRGEHPSWTVYVQTLTPEQAEAFRWNVFDLTKVWPQSEVPLRPFGRLTLNRNPDNYFAEIEQVAFSPSHLVPGVEPSADPVLQSRLFSYPDTHRHRLGVNYQQIPVNRPLNAFNPHQRDGAMSVDGNYGANPNYPSSFRPLNYKPVKAAGAHKQWAGKVVEDLFGPVTAQDYEQAAGLWAVLGRQDGQQRNFVLNVSGALAGARADVRARVYDMFSKVDAGLGAAIETETEAVAKPADVRSKL

SEQ ID NO: 17590 - protein, 281 aa, Pseudomonas fluorescens PfO-1
MSQDRRYSFEFFPTKTDAGHEKLLATARQLATYKPDFFSCTYGAGGSTRDRTLNTVLQLESEVKIPAAPHLSCVGDSKDDLRGLLNEYKAAGIKRIVALRGDLPSGMGMTSGELRHANELVEFIREETGNHFHIEVAAYPEMHPQARNYEDDLANFVRKARAGADSAITQYFFNADSYFYFVDRLQALGVDIPVVPGIMPITNYSKLARFSDACGAEIPRWIRKQLEAYGDDSQSIQRFGEQVVTEMCERLLQGGAPGLHFYSMNQAEPSLAIWNNLKLPR

SEQ ID NO: 17591 - protein, 456 aa, Scytothamnus australis
YNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLCGGLDFLKDDENINSQPFMRWKERFLYCMEGVNRAAAATGEVKGSYLNITAATIEQMYERAEYAHAIGSVIVMVDLVIGYTAIQTMAIWARKAEMILHLHRAGNSTYARQKNHGINFRVICKWMRMCGVDHIHAGTVVGKLEGDPLMVKGFYNSLLLTHLKINLAEGLFFDMDWASLRKCVPVASGGIHCGQMHQLLYYLGDDVVLQFGGGTIGHPDGIQSGATANRVALEAMVLARNEGRDYVGEGPQILRNAANSCGPLKAALDLWKDITFDYTSTDTPDFVEVSTESK

SEQ ID NO: 17592 - protein, 309 aa, Glycine max
MPVVTEHMKWRRPRNQFRNPISETDDPITQIPSIIQSSHSKSTISSLLSSFSTSGETTHARDQNRTNNNNKSNRKFSAATFRGFGCTAGSSQKVSVPAVIRSSADWEGKRNRKKNHRRKSNSNGNSGNNTCDDDDDDVSGGTFVDFQDVSCGPGIGFSTDAASVVGAGARKNVSARGKLDVVEDRVTHRERSSYFGRRTVKPESFSFLEDEPDIFAARPGLEPFGTARFYRHVPHPSPDGLAEIMILQGRIMMGGRFDSHDQFRDWRLDVDNMSYEQLLELGERIGYANTGLKEDEMVLYIMKVKPSCS

SEQ ID NO: 17593 - protein, 338 aa, Agaricus bisporus
MVKVGINGFGRIGRIVLRNALQFQDIEVVAVNDPFIDLEYMAYMFKYDSVHGRFKGTVEVKNGSFVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 17594 - protein, 499 aa, Sphingomonas sp.
MATQLKSGTNEYGIKSEYGHFIGGEWISSDSGKTIDLINPATGAVLTKIQAGNAKDIQRAVAAAKAAFPKWADSSAAERQEILIEVARRLKARHQHYATLETLNNGKPIRESMHFDMPQAIGQFELFAGAAYGLHGQTMDYPDAVGIVHREPLGVCAQIIPWNVPMLMMACKIAPALASGNTVVLKPAETVCLSVIEFFVEMADLLPPGVINVVTGYGADVGEALVTHEDVRKVAFTGSVGTARRIMQYASTNIIPQTLELGGKSAHIVCADADIDAAVESATMSTVLNKGEVCLAGSRLFLHESIQDEFLAKFKVALEGIRQGDPLDFATQLGAQASQMQMDKVISYLELATEEGANVLTGGSANDKLADGNFIRPTVFTNVNNSMRIAREEIFGPVTSVISWKDEDDMMKVANDTNYGLAGGIWTRDIARAHRMARKLETGTVWINRYYNLKANMPLGGYKQSGFGREFSHEVLNHYTQTKSVVVNLQEGRTGMFDQ

SEQ ID NO: 17595 - protein, 419 aa, Polyopes polyideoides
ETDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIAPNEGRDYVTEGPQLLQDAAKTC

SEQ ID NO: 17596 - protein, 493 aa, Agrobacterium tumefaciens str. C58
MKPTLDKDLDKITRVEEATLHVTQQLAGLGAGFMFVVLAAVFAGAFVTGTAGSVIIIAAVALGAYMAINIGANDVTNNVGPAVGAKAMPLAVALIVAAICEIAGALITGGNVVETISSGIINVETIPDRTAFSWAMLSALLAAGLLVNISTWTRAPISTTHTVVGGVAGAGMAAYGAKAVEWLSLGSIAFAWVLAPFISAAIAIAILTFIKEFIVYRDDKIDAARRWVPVLIGLMAGVFMAYLIWVGLRQLMHVSLGHASIIGLVTGLLAWRLCVPIIRKQSEGLENRNQSLRILFQWPLVLAAGLMSFAHGANDVSNAIGPVVAIVRALHDEAVQTSARAPLWVMLVGAFGLSCGILLYGPRLIRLVGEQITKLNPMRAFCVSVATALTVLVASRFGLPVSTTHTAIGAVFGVGFFREWYTQASRRRQELVQSGTGEPRRTPRYLDNPSEVRRRYLVRRSHFMTIIAAWVVTVPASATLAALLYWLLSFLFL

SEQ ID NO: 17597 - protein, 306 aa, Oryza sativa
RGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAVKPVKGDTVLFFSLHIDGVPDPLSLHGSCPVIEGEKWSAPKWIRIRSYEHPPVSKVTEGCSDNSARCAKWAEAGECEKNPVYMVGAEGLPGNCRKSCGVCDS

SEQ ID NO: 17598 - protein, 424 aa, Methanosarcina barkeri
MEFKQGDRVRIEKNGTVYEGKVMPSMEGYITIKMNSGYNAGFSMDKVKITLLENNGENTNGGLNGGKEHKTAGEEVQKSGKKLPKVAILSTGGTIASKIDYRTGAVTSQFTADDILAAIPELREIADFKGRVISSILSENMDSESWQNLARAIVEEIEAGADGVIVTHGTDTMMYTAAALSFMIETPVPIVIVGSQRSADRPSSDNAMNAICAALVAISDIAEVSVVMHGTTSDDFCEIHRGTKVRKMHTSRRDAFKSINSRPIGIVDYNTRKIKTFIDYIKRGERPLKFNPGMEPKCALVKFTPGSGPEILDHYIDSGYRGLVLEGTGLGHVSTKWIPKIQKATDAKMPVIVTSQCLNGRICDRVYDTGRDMLKAGAIEGEDTLPEIALVKLMWVLGQTDEFNEAVKMLREDISGEITKCCFK

SEQ ID NO: 17599 - protein, 419 aa, Neisseria pharyngis var. flava
FTIPTRIVLDDPEEWFENGQAFDGSSIGGWKGIQASDMQLRPDPATAFIDPFFDDTTVVLTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 17600 - protein, 238 aa, Saccharomyces cerevisiae
MVKPIIAPSILASDFANLGCECHKVINAGADWLHIDVMDGHFVPNITLGQPIVTSLRRSVPRPGDASNTEKKPTAFFDCHMMVENPEKWVDDFAKCGADQFTFHYEATQDPLHLVKLIKSKGIKAACAIKPGTSVDVLFELAPHLDMALVMTVEPGFGGQKFMEDMMPKVETLRAKFPHLNIQVDGGLGKETIPKAAKAGANVIVAGTSVFTAADPHDVISFMKEEVSKELRSRDLLD

SEQ ID NO: 17601 - protein, 312 aa, Desulfovibrio vulgaris subsp. vulgaris (strain Hildenborough)
MASDCTAHYNTAFSLQSALWRFLVILYLKLLLAAFFWGGTFVAGRIGAAHAGPFALAFLRFTLATAILVWHIRRREGALPQVSGSRNILFVLLLGATGIFAYNALFFTALQTIPAGRAAVVVANNPIVIALGAALFLGEPLTRRKCIGIAISVCGALVAVTRGDPVSFLQGGVSWGDVALVGCLASWAAYSLLGKKAMSSLSPLAAVTWSCASGACMLLPFALHEGMLDAITTYTPDVWASIFYLGMFGTALGFTWFYEGVDRIGAAKAGVFINFVPITAILSGWLFLGEPLSPSLILGAALVLTGVYTANR

SEQ ID NO: 17602 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVTDYLWLFEEHNVLEYLILAGDHLYRMDYEKFIQAHRETDADITVAALPMDEQRATAFGLMKIDEEGRIIEFSEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLAAKGSVPIGIGKNSHIKRAIIDKNSRIGDNVKIINSDNVQEAARETDGYFIKSGIVTVIKDALIPTGTVI

SEQ ID NO: 17603 - protein, 482 aa, Hypoglossum hypoglossoides
AEQAIKNERYESGVIPYAKMGYWDPNYVIKETDVLALFRVTPQPGVDPVEASAAVAGESSTATWTVVWTDLLTACDLYRAKAYKVDAVPNTSDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQSMGIWARKNDMILHLHRAGNSTYSRQKIHGMNFRVICKWMRMAGVDHIHAGTVVGKLEGDPLMIKGFYDTLLLPHLDINLPLGIFFQQDWAALRKVTPVASGGIHCGQMHQLLDYLGEDVVLQFGGGTIGHPDGIQAGATANRVALESMVIARNEGRDYVAEGPQILRDAAKTCGPLQTALDLWKDITFNYTSTDTADFVASPTANV

SEQ ID NO: 17604 - protein, 465 aa, Yersinia pestis CO92
MKIVNHWIDGKNITSNDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLARSIEAGMVFVNTQNVRDLRQPFGGIKASGTGREGGKYSFDVFAEVKNVCISMGEHPIPRWGM

SEQ ID NO: 17605 - protein, 144 aa, Nitrosomonas europaea ATCC 19718
MAITRYEPWGLLTQLQRELERARDDMATEGASAIAEWAPAVDIKEESDKFIVHADLPGVKPEAIDVTTENGVLTIKGEKQTEARTEKEGYKRVERTHGSFYRRFSLPDTADLGAISAVTKDGVLVVTIPKREAVQPKKVSVTAQ

SEQ ID NO: 17606 - protein, 135 aa, Haemophilus influenzae
EDPIPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 17607 - protein, 522 aa, Oryza sativa
MAKPECVSTPATSLGRCSPMAMMAMGAASWAPIPAPARAAAAFYPGRDLAAARRRRGAAARRPFVFTPRAVSDSRSSQTCLDPDASTSVLVVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKPSRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 17608 - protein, 231 aa, Campylobacter jejuni subsp. jejuni NCTC 11168
MSLYDRDYSRSKEFENTRSSELSIFIKQTYQLFAASLLAATVGAYVGIFALASFFIQSQVTFWILFAVEIGLLFALQWKKREAPLNLVLLFGFTFCSGLTLTPLLISVLALPAGGIIIAQAFALTTVAFAGLSVFAMNTKKDFTVMGKALFIVLIVIVAASLLNLFFQSSIVNLAISAVAAILFSFYILYDTQNIIRGNYETPIEGAVALYLDFVNLFVSLLNILRSFNSR

SEQ ID NO: 17609 - protein, 250 aa, Solanum tuberosum
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 17610 - protein, 322 aa, Dendrobium hybrid cultivar
MEKLNNYMAVLRDACENWGFFSHFQATLSHELMDKVEHISERYIKKFREQKFKDICSHNSGNFCNTQVNDIDWESTFYLRHRPTSNISKSPEDLDDQYRKLMKEFAAQIERLSEQLLDLLCENLGLEKAYLKNAFYGANGCNPTFGTKVSNYPPCPKPELIKGLRAHTDAGGIILLFQDDTVSGLQLLKDEEWIDVPPMRHSVVVNLGDQLEVITNGKYKSVMHRVIAQTDGNRMSIASFYNPGSDAVIYPAPTLVEKEKETYPKFVFEDYMKLYVRQKFEAKEPRFEAMKTMDAVISSQPIPTAPLPLEAIRGGGYPGDLL

SEQ ID NO: 17611 - protein, 188 aa, Zea mays
  unsure (1)..(188): unsure at all Xaa locations
MSRRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGYTQHGGLXSPFGVSFIYAGWDPRRQFQLYLSNPSGNYXGWKATSAGANNASAQSLLKQDYKEDCTFEE

SEQ ID NO: 17612 - protein, 52 aa, Triticum aestivum; identical to SEQ ID NO: 3419

SEQ ID NO: 17613 - protein, 248 aa, Magnetospirillum magnetotacticum
MATRNVSDLIVETLQQAGVRRIYGLVGDSLNGITEAIRSRSVIDWVHVRHEEVAAFAAAGEAQVTGELAVCAGSCGPGNLHLINGLYDAHRTRTPVLAIAAHIPSSEIGLNYFQATRPEELFRDCSHFCELVSDPEQLPNVLETAIRTAVGRRGVAVVVIPGTVALKEAPKRAIAAAATLHPRAPVAVPPADELDRLAALLNGSQKITLLCGRGCAGAHAPLMRLAERLKSPIVHALRGQEPVEHENP

SEQ ID NO: 17614 - protein, 187 aa, Thujopsis dolabrata
ICTYFAQPLHQRDYSRWPLKPEGWREIVDKYSEALMGLASKMLAIVSEALGLEPDAVTKACVEMDQKVVINYYPKCPEPDMTLGLKRHTDPGTITLLLQDQVGGLQATKDDGLNWITVQPVQGAFVVNLGDHMHFLSNGKFKTADHQAVVNSNYSRLSIATFQNPSQDAIVYPLKLEEGEECFMEEP

SEQ ID NO: 17615 - protein, 313 aa, Novosphingobium aromaticivorans
MNASYDQLREARTALDTPLFAGLPGDIAVSFEFFPPKSDALMAQLWDVVETLAPLQPTFVSVTYGAGGSTRDRTHGTVARIIKEAKLPAAAHLTCVDASKAEIREVAESYWEAGVRHIVALRGDMGAPGVPFTPHPDGYANAAELVAGLKQIAPFEISVAAYPESHPDSPDQQADIDNLKRKLDAGATRAISQFFFEPETFFRFRDKLAAAGIDAPVLPGILPVSNVAQTRKFAAACGAAIPAWMDGLFEGLDTHPASRQLVAATIAAEFCRRLYAGGVRDFHFYTLNRAELSYAICHLLGLRPRTPALEKAA

SEQ ID NO: 17616 - protein, 369 aa, Avena sativa
MDGAPVAEFRPTMTHGGRFLLYNIFGNQFEITSKYQPPIMPIGRGAYGIVCSVMNFETREMVAIKKIANAFDNNMDAKRTLREIKLLRHLDHENIVGLRDVIPPSIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRPFPGQFPKVQPAALDLIERMLTFNPLQRITVEEALEHPYLERLHDVADEPICTDPFSFDFEQHPLTEDQMKQLIFNEALELNPNFRY

SEQ ID NO: 17617 - protein, 413 aa, Fagus sylvatica
MAGICCGVVGEGETTAPIELSSRPSRRRRIDLVPLKLMADVAAPQPLETDKKRQKLCLNTTSSLPSQVVENCKCVEEENEEKKKTNKNEALHTNQAANSCESSKPVEGRNNEEAVQECPKFGVTSVCGRRREMEDAVSVHPSVSNNFHFFGVFDGHGCSHVAMRCRDRLHDIVKEEVESVTEGMEWKDTMEKSFDRMDKEVQEWRVPIKTTNCRCDVQTPQCDAVGSTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWDVVSNETACGVARMCLRAQKPSSPPRSPGNDMAVGAASESSDKACSDASILLTKLALARHSTDNVSVVVVDLRRNHQQ

SEQ ID NO: 17618 - protein, 686 aa, Bacillus subtilis subsp. subtilis str. 168
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFPYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 17619 - protein, 150 aa, Betula pendula
GVKCLLDDEAIRVGGANHSHATKDLYDSIGAGNYPEWKLYIQIIDPDHEDKFDFDPLDVTKIWPEDILPLQPVGRLVLNKNIDNFFAENEQLAFCPSIVVPGVYYSDDKLLQTRIFSYSDTQRHRLGPNYLQLPANAPKCAHHNNHHEGF

SEQ ID NO: 17620 - protein, 319 aa, Corynebacterium glutamicum ATCC 13032
MQVTESGSTASPLCGVGSSVMTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 17621 - protein, 441 aa, Callophyllis violacea
  unsure (1)..(441): unsure at all Xaa locations
PQPGVDPVEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGIIVERERMDKFGXPFLGATVKPKLGLSGKNYGRVVYEGLKGGLDFLKDDENINSQPFMRWKERFLYSMEGVNRSIAASGEVKGHYMNVTAATLEEMYERAEFAKQLGTVIIMIDLVIGYTSIQTMAVWARRNDMILHLHRAGNSTYSRQKIHGMNFRVICKWMRMAGVDHIHAGTVVGKLEGDPLMIRGFYNTLLQSYLPVNLPQGIFFEQDWASLRKVTPVASGGIHCGQMHQLLDYLGIDVVLQFGGGTIGHPDGIQAGATANRVALETMVMARNEGVDYVTEGPQILQDAAKTCGPLQTALDLWKDITFNYTSTDTADFVETPTANV

SEQ ID NO: 17622 - protein, 207 aa, Zea mays
  unsure (1)..(207): unsure at all Xaa locations
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWXXVLPLELTVCGTVIQYWAPDTSVAIWVSVFLXVIIIVNIFGTLGYAEEEFW

SEQ ID NO: 17623 - protein, 473 aa, Zea mays
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVSDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 17624 - protein, 460 aa, Lycopersicon esculentum
MDSSWEASVTDSINAIYLLFSAYLVFVMQLGFAMLCAGSVRAKNAMNIMLTNVVDAVVGSLSYYLFGFAFAFGDSNPFIGASYFALKDIPSSSYDYSFFLYQWAFAIAVAGITSGSIAERTQFTAYLVFSFFLTGFVYPVVAHWLWSSNGWLSPNSTYLLFGSGAIDFAGSGVVHLVGGIAGFWGSIVEGPRVGRFDAFGNPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCSVVEPWAAILCGFCAAWVLIGLNILALKFKFDDPLEAAQLHGGCGAWGLIFTGLFAKEEFVLQAYNSGKTQIIRPSGLILGGGWGLFGAQIVELLSIVVWVSLTMGPLFYLLQKLGILRISSDEEVAGLDISSHGGYAYDASQEESNARFYGEYLRMQQQ

SEQ ID NO: 17625 - protein, 383 aa, Pyrococcus furiosus DSM 3638
MVRVAIIGQGYVASIFAVGLERIKEGELGYYGIPLANELPIKVEDIKIVASYDVDKTKIGLPLSEIVQRYWKGNVPESLQEVFVRKGIHLGSLRNLPIEATGLEDEMTLKEAIERLVEEWKEKKVDVIINVPTTEAFTPFGKLEELEKAIKDNNKERLTATQAYAYAAAQYAKEVGGAAFVNAIPTLIANDPAFVELAKESNLVIFGDDGATGATPLTADILGHLAQRNRHVLDIVQFNIGGNTDFLALTDKERNKSKEYTKSSVVEDILGYDAPHFIKPTGYLEPLGDKKFIAMHIEYISFNGARDELIIAGRINDSPALAGLLVDLARLGKIAVDKKEFGTVYPVNAFYMKNPGPKEAKNIPRIIAYEKLRQWAGLPPRYL

SEQ ID NO: 17626 - protein, 470 aa, Lactobacillus plantarum WCFS1
MAYQTINPYTNEVVKTYDNATTDQIEQALTTGDALYHQWRHEPVSSRAASLHKIAALLREHKDELAKIATIDMGKLLSESQGEVELCAMIADYYADHGAELLAPTPISTQATGDAEIEKQATGVLMLVEPWNFPYYQIMRVFAPNYMVGNPMILKHASNTPGSAAAFAKIVEEAGAPAGSLTNLFLNYDQVSDIIADPRIQGVALTGSKRGGQAVAKAAGANLKKSSMELGGSDAFVVLADADIDEAVNLAWRVRLYNAGQVCTSSKRFIVAADVYDDFLAKLKERFAKLVPGDPMDPQTTLAPMNSKRAKEKLQDQVDRAIAGGATVAYGNEPIDLPGQFFQPTILTDIDQDNPLFYEEMFGPVAQVFKVDSEQAAIDLANNSELGLGGIVFAGTAAHGKAVAQQIETGMVFVNTFLSSLPELPFGGVKGSGYGRELSSLGLMAFVNEKLVVTAQKPDYDNGAGGLVVL

SEQ ID NO: 17627 - protein, 187 aa, Klebsiella aerogenes
MILLIDNYDSFTWNLYQYFCELGAEVLVRRNDELTLADIISLAPAKIVISPGPCTPDESGISLAAIRHFSGQTPILGVCLGHQAIAQVFGAAIVRAAKVMHGKTSPVSHTGQGVFLGLNNPLTVTRYHSLLIDPRTLPECFEVTARSEEGEIMGIRHRVFDLEGVQFHPESILSEQGHQLLANFLNR

SEQ ID NO: 17628 - protein, 449 aa, Zea mays
  unsure (1)..(449): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGXWCKQKLGANAILAVSLAVCKAGAMVKKIPLYQHIANLAGNKTLVLPVPAFNVINGGSHAGNKLAMQEFMILPTGASSFKEAMKMGSXEVYHNLKSIIKKKYGQDATNVGGIEGGFAPNIQENKEGLELLKAAIEKAGYTGKVVIGMDVAASEFFGEKDKTYDLNFKEENNDGSNKISGXSLKDLYKSFVSEYPIESIEDPFDXDDWSTYAKLTDEIGQKVQIVGDDLLVTNPXRVAKAINEKXCNALLLKVNQIGSVTESIEAVRMSKRAGWGVMASHRSGETEDTFIADLSVGLSTGQIKTGAPXRSERLAKYNQLLRIEEELGDAAVYAGAKFRXPVEPY

SEQ ID NO: 17629 - protein, 427 aa, Arabidopsis thaliana
MQNPRLKQHQQQQQQQAMMQQQALMQQHSLYHPGVLAPPQLEPVPSGNLPPGFDPSTCRSVYVGNIHTQVTEPLLQEIFTSTGPVESSKLIRKDKSSYGFVHYFDRRSAALAILSLNGRHLFGQPIKVNWAYATGQREDTSSHFNIFVGDLSPEVTDATLYQSFSVFSSCSDARVMWDQKTGRSRGFGFVSFRNQQDAQTAINEMNGKWLSSRQIRCNWATKGATSGDDKLSSDGKSVVELTTGSSEDGKETLNEETPENNSQFTTVYVGNLAPEVTQLDLHRYFHALGAGVIEEVRVQRDKGFGFVRYNTHPEAALAIQMGNTQPYLFNRQIKCSWGNKPTPPGTASNPLPPPAPAPVPGLSAADLLNYERQLALSKMASVNALMHQQGQHPLRQAHGINAAGATAAMYDGGFQNVAAAQQLMYYQ

SEQ ID NO: 17630 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 17631 - protein, 533 aa, Emericella nidulans
MSILALVEDRPTPREVYNWRVYLLAAVASFTSCMIGYDSAFIGTTLSLQSFQNEFNWESLNTDLISANIVSLYQRGAFFGALFAYPIGHFWGRRWGLMFSALIFFLGAGMMLGANGDRGLGLIYGGRVLAGIGVGAGSNICPIYISEMAPSAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVTAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 17632 - protein, 620 aa, Zea mays; identical to SEQ ID NO: 3301

SEQ ID NO: 17633 - protein, 170 aa, Streptococcus pneumoniae TIGR4
MNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 17634 - protein, 408 aa, Caulobacter crescentus CB15
MADSPSANLRNLTVEEARRRMLDGASRLGVETAPLAESLGRTLAEPVVAGRAQPPFAASAMDGWAIRRSDYAPGAAFRIVGESAAGAAYPRPVASGEAVRIFTGAPVPAEADLVIIQEEATREGDQVRFDAGPDPRANVRAAGGDFKDGDTLLLDGVVIDPWRLSLIAAAGRAEVSVARRPRVAILATGDELAPPGASPRPDQIFESGSYGLAALIEAWGGEAIRLSPQGDDAQAIASAVSPAPVDVIVTIGGASVGDHDLVKPALRTLGLALSVETVAVRPGKPTWSGRLPDGRRVVGLPGNPASALVCAELFLRPLLAALTGAAPDIRLIPAGLAAPLPAGGPREHWMRAALSTDPDGRVVATPFPDQDSSLVSVFARADALLRRRPGAPPAATGEVVDVLPLRRG

SEQ ID NO: 17635 - protein, 430 aa, Xanthomonas campestris pv. campestris str. ATCC 33913
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 17636 - protein, 425 aa, Escherichia coli CFT073
MIDRLPGVSTLTLQPKTPFLQALDACFRVAYSLDNLPYHQRCPVFKSDAARTRQRLSARKGRTLPPGRGKFPHSTMESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWRGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGIAEDAAKRGHLTASTVIQYRGAIIPREAMPA

SEQ ID NO: 17637 - protein, 136 aa, Corynebacterium glutamicum ATCC 13032
MTDFKLISDTEWRERLTPQEFHVLREAGTEPPHVGEYTNTTTEGVYSCRACGEELFRSTEKFESHCGWPSFFSPLAGDKIIEKEDLSLGMRRVEILCANCGSHMGHVFEGEGYDTPTDLRYCINSISLKLEEKPVS

SEQ ID NO: 17638 - protein, 634 aa, Triticum aestivum
  unsure (1)..(634): unsure at all Xaa locations
HASGGPSYGYRGRVMLAFEENGSSKIGVRFDKQIPDGNDLGGLCEEDHGFFXLVVSVRKIMSSXGSAELLCPDPSGSXIISKESKIGSLIGVLKDVEKSFTGITESFSSLRNKLELLPPGVLIVGSHTQMDSRKEKAHPGGFLFTKFASSSQTLFDLFPDSFGXRLHERNKESPKAMKHLNKLFPNKISIQLPQDEALLTSWKQQLDRDVETLKAKSNIGSIRTFLNRSAIECSDLEELFIKDQSLTNENVDKIVGYAVSYHLKHNKVETSKDGKLIITSGSLKHGLDMLQSIHSDNKSSKKSLKDVATENEFEKRLLADVIPPNDIGVTFDDIGALENVKETLKELVMLPLQRPELFCKGQLTKPCKGILLFGPPGTGKTMLAKAVATEAGANFINISMSSITSKWFGEGEKYVKAVFSLASKISPSVIFIDEVDSMLGRRENPGEHEAMRKMKNEFMVNWDGLRTKDKERVLVLGATNRPFDLDEAVIRRFPRRLMVNLPDASNREKILKVILAKEELGQDTDLESLANMTDGYSGSDLKNLCVTAAHYPIREILEKEKKEKNVAKSEGRPEPALHGSEDVRPLSLDDFKSAHEQVCASVSSDSANMNELVQWNDLYGEGGSRKKKALSYFM

SEQ ID NO: 17639 - protein, 527 aa, Aspergillus niger
MAPTYAGLSGRKLSLAVSTIATMGFLLFGYDQGVMSGIISDTAFEDLFTATKNNPTMQALVTSVYELGCLVGAMFALFFGDKTGRKWMIFSGAIVMIIGVVIQVTSYAGHIPLLQFFIGRVITGIGNGMNTSTIPTYQAECSKTSNRGLLICIEGGIIAIGTAIAYWIDYGAHFGNKDLVWRFPIAFQIFFGLIIIVGMWFLPDSPRYLISKDRVQEGEYVLAALGGWEIHDHETQLQKQLVIDSIRASNAAGKDVGYRDLLTGGRSQHFRRMVIGSSSQIFQQLGGCNAVIYYLPVLLQDSLHETENFSLVIGGVNMIVYAIFATFSWFFIEKIGRRKLFLGGSFLQCIAMVITFACLIPGDQETAKGAVFGLFLYMAAFGAAWLPLPWLYPAELSPIKTRAKANAVSTCSNWLFNFLIVMITPVMVSHIGWGTYLFFAVLNGLFIPFIWFFYPETANRSLEEIDIIFAKGYTENISYVRAAHELPKLTDEEVEQKAMEYGFGGASDEEKVTTAEVSGSNSARESE

SEQ ID NO: 17640 - protein, 181 aa, Triticum aestivum
FQPSDDFPEFKLPDVPAPLAENLNGKHEPKSPKAAPRSPKAATHPTFATSVKKPIGAKKVGAKTGGLGVRKLTTKPNESLYEQKPEEPKPAVPALAASTTAKGGPSLHSRFEYVENVPSADLRTGGSGSRVTGHVAPPKSSDFFQEYGMGNGFQKKSSNASKTQIEETDEARKKFSNAKAI

SEQ ID NO: 17641 - protein, 939 aa, ASPERGILLUS NIDULANS FGSC A4
MTGRNAPRSKNGCSTCRRRKVKCGEERPVCKRCSALGITCEWAAVVKRGRSHTPVPIQPARARRPTTTAAATSSTAEQPPLDFNSLALSPQFSQMLCPEALFPEIWTFLPAAFTAPTPLYPSLSGTDIACSNSLMLMEQDQIYFQYFPSSSVVFYYIKSWAWSGFSYLYQGPAASSKVVMRMILALAANDMHRNGLLVRSPGRPSAEDHARYHYGLAVKEFRQLLETREKPLSQPELEIVFASMFLMISYEWQFGQSVQDLQLHLRGVRSLLESHSKLFEGKEVDEVLMFMDTVQSEAAPQVSFIPEQLLLWIIYIDSGCRSMGTADSLTEYVLQSGNQAIHPDRLYRCARLWGRCFWGKQYPDQEVSDDMENYRALELLHAGMTLRYKIWQALSDDAVQTNNQAELLLKEIKATREVWFFQTVLDFAGPASTRRTLNTINMAVSTFYAQVLFHRRLLYPPGPPSPFQRVAVTNIIEIARKQYASDPRLLRRIHWPLLMAIIETDDISQQRIDGTISINSHMTKMSIQTAWEACNKTDTLFILVCSVFCWLIIPAVGLAYSGYSTRFNSLASFYPGLLAVAVCSVQWWMIGYSLAYSEGNAFIGGLSKAFHIGVLAEPIGTIPEILFSEFQLIFCATVCAIAIGGACERGRLLPLIPFIFLWSTFIYAPLAHMVWSDNGFLAQLGALDFAGGTPVHICSGATATAMSIYLSYPLFRSRRSTKRTPQHLRLHKPHNTLCQLLALMIIWNAWLAFDAGTTLALNFKSIMAACVTNLCAASGALTWAGLTYAETGKFSLDSTFLGAIAGLVLITPSAGFIDLSTSVAFGVVGAVAGRQALRIKFTKGAALRRWVDNGDTFATHCLGGLLGTVATGLFAQREVAAYDGVTIIAGGCVFDSNWRQLGVQLVEALIGFTWSFVGSYVLYALVDCVPGLEVLATDE

SEQ ID NO: 17642 - protein, 222 aa, Triticum aestivum
  unsure (1)..(222): unsure at all Xaa locations
MTSPAPAPPAAAAAQSPPPRIGLAGLATMGQNLALNIAEKGFPISVYNRTAAKVDSTLSRAAAEGALPVLGHRDPRDFDLSLARPRTVVLLVQAGPAVDATIDALSPYLXAGDAIVDXXATSGNQNTERPVEQAASRGILYLGMGVSGGEEGARNGPSLMPGGDFQAYSNIKDILEKAAAQTEDGPCVTFVGPGGAGNFVKMVHNGIEYGDMQLIAEAYDVL

SEQ ID NO: 17643 - protein, 130 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 17644 - protein, 230 aa, Zea mays
MRSMLFLRCQPRVSSPSPSASAPPFRPRVGVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 17645 - protein, 1870 aa, GIBBERELLA ZEAE PH-1
MKGSDSLRRANRPAANFDLPPVALAQAQQQTQVQAQAQAQSFQSQSQPQESITNTVTSTSPEITNASLHGQAQAKAQALTTARFRSSSRPSLQDLALVDGTSTSNNHDLPPAYALSSSSSSTGPSSFSYPPAHVHPRPSTANAAATTHTHTRPRPLGPSSSDIATAEQAQFLRIHPVSSTSSLRPRSSTTSASAVASASASTSPSHTPNSLLRQHTSPPSAVDNNSAHFVPRGGLPPAPSIMYQANQRHVSGTDPSRPYQVPPPPPPPMGGPNNGHMPNMMNLPPPPPLPRYNTAPGSNGLSLPPPPGPPPASALGQQPPWHGAFGRMYDSRSGFNIPPPPPSSQHQPYNPKLHAQIAAGQTVSIPPPPPPNEAMSATYIPQGDTYGEGVGIPAFGLEDPTLTVNSQTLRPVTTPQSGTDTNATTPMDEATRERLYAANNAQPRGTSNSSNPTPPGSIPPEIAAQWPLDTVLLWLAQNQFSKDWQETFRALNLHGAQFLELGSGHGGRGNFGMMHQQVYPRLAQECTNSRTGWDQPREREEGKRMRRLIRSIVTGRPADVSKVSTSHGRKESLNGGHGNNLPSAGTDPMDSPNTPLTAPGPGFSSRRFSQTRSTTLPNSISASNINSESNHRNILKHVDTDGARRHSPNVSESSEATFRAPAVHSASPTGSPGIPPALYTSTTTPTIAQSPSAIKAGHRSRSSMDSVASVAAIYGSGVPSDAASLLNRNMNLGDIVHGRSHDARSRHSPSDGGDRSAGGETPSSAKDSNRLLSFLSRKKKQTKDDGAYPSPEDMNGSPTSPHGSFRPVGLGVRGSNGSDTNIDLSGSTLGDDRNGSTLNMRWNKISPVRTYVLATMDYWNYRMCDITEAETATEIRQVICMHLGLGDYENSHIYLTEAGKFEHVDPLDDPSLITVRRAKGDPLGTLKFFVTPPGVAPISSLSVKAEVPIILSPSYLSPGTPVEDAQQMSRQRSSSSPPTSRSNTLTNEKNEDKIAREAKQYRAEIERKQQEYLAKRKQAAMKGSPSETLGPGIVGRNVDFDQPRESPYEDKRPEPLFPQRRPPAPPSDPSATLIKANSLSRKTGASMRASSSSLEGYPSKRYPENEMAEKTKKANKQAPPAPGIGAALAGMGRNLSAIGQSAKNGRASSPSRSSTHSIPGGKDTFSTVEPSQGRGSPSTTSSSKLTTGNVTWNKKNLGFIVPDYSPSDSSFLLSPSPTVDAKFNATVPRAMSPAEMSPNSSRSRTSFPPNQQSPTHRRASHGPEPEFEDTDVHFSKPAPAPPADDDSDDSDDGLFAIPIANQNKGKAAAANADANGHSKRPSLHVNTERSRKGLSVAFKSPKSFGSGMDSNEDSGRQNPTTPHSETWEPEEKDKESKLGRRKSFIEKDVWANRPPTDALINNLDDFFPNLDLDQPVLDEPGESGMPPSPIAESSETNIDQQAQNVAPPQPSYPQHVPPAIPPTRQPSLYNENDTLGSDESTLKALDQHRPTSVAQRSIRRSGGLGRMKSIREVARGAHEANKRTTSTNQGQAATTNIMRRKSTKMFNANIVQIRPDRRGSVVMPQIPQDTVPKRQTTFRWFKGQLIGKGTYGRVYLGMNATTGEFLAVKEVEVNPKAAGGDKNKMKELVAALDQEIDTMQHLDHINIVQYLGCERKETSISIFLEYISGGSIGSCLRKHGKFEESVVSSLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGKRPWAKEEAVGAIYKIANGERPPIPEDIQDTLGPLAVAFMMDCFQVNPFDRPTADVLLSQHPFCEVDPHYQFYDTALYHRIKSFK

SEQ ID NO: 17646 - protein, 314 aa, Rhizobium leguminosarum bv. viciae
VMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 17647 - protein, 446 aa, Zea mays
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 17648 - protein, 360 aa, Glycine max
IRLEYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKELPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETEADKRFLAAKGSVPIGIGRNSHIKRAIIDKNARIGENVKIINSDNVQEAARETDGYFIKSGIVTVIKDALIPSGTVI

SEQ ID NO: 17649 - protein, 196 aa, Methanothermobacter marburgensis str. Marburg
MNKLILIIDNYDSFTHNLYQMAGEIMMEMDSADIMVVRNDEVDIDYVRGLDPERIIISPGPGNPIKREDFGICSEVIGEFTDRPILGVCLGHQGIFHYFGGVVGYGEPVHGKISEVFHDGSELFRGVPNPFRATRYHSLRCECSGVPEDILVSASAPDGTIMAIRHRQYPVYGLQFHPESAGTPHGRDILENFLRM

SEQ ID NO: 17650 - protein, 307 aa, Methanosarcina barkeri
METVNNPLTFVVASTRPAGPVVVTKDTDIVIKEKSAEEIRVPEGISYEDIGGLRREIQLVREMIELPLRHPELFQKLGIEPPKGVLLHGPPGTGKTLIAKAVASETDANFITISGPEIVSKYYGESEQKLREIFEEAEKEAPSIIFIDEIDSIAPKRGEVTGELERRVVAQLLSLMDGLNSRGEVVVIAATNRPNSIDEALRRGGRFDREIEIGIPDRNGRKQILLIHTRGMPIQDVSLSEIADVTHGFVGADLSSLCKEAAMHALRRITPEIDIEEDEIPQEILDKLVVTKDDFKEALKEISSRLQ

SEQ ID NO: 17651 - protein, 416 aa, Gracilaria gracilis
MAFVAPVSSVFSTSSKSAVCSGRSSFAQFSGLKKVNNTARLQTAEQGSAFGGVSDANDAFFNAVNTMGAPARTSNAPSMKVRVAINGFGRIGRNFIRCWAGRTDSNMDVVCINDTSGVKTASHLLKYDSILGTFDSDVVAGEDSITVDGKTIKVVSNRNPLELPWKEMEIDIVVEATGVFVDAVGAGKHIQAGAKKVLITAPGKGEGVGTFVVGVNDHLYSHDKFDIVSNASCTTNCMAPFMKVLDDEFGVVRGMMTTTHSYTGDQRLLDAGHRDLRRARSAALNIVPTTTGAAKAVALVVPTLAGKLNGIALRVPTPNVSVCDVVMQVSKKTFKEEVNGALLKAANGSMKGIIKYSDEPLVSCDYRGTDESTIIDSSLTMVMGDDMLKVVAWYDNEWGYSQRVVDLGEVMASQWK

SEQ ID NO: 17652 - protein, 216 aa, Glycine max
  unsure (1)..(216): unsure at all Xaa locations
MFGPTQTASQPPKSTLKFLCSYGXGKILLRYPDGKLRYLGGHTCVLAVDRSIPFSELLLKLEELCGASVRHLRCQLPSEDLDALVSITSDEDLXNLIEEYDRVSSLKIRAFLSPPTPPRSPSLKVSTPPSKSASISSSSASSSSSSSSYCSPTGASDSGRRYRAPAPVSDRCVHQMSPSPAAYPVGVEKSKSSGRNIPLPRYGGHVYMIHNGNHWQ

SEQ ID NO: 17653 - protein, 148 aa, Zea mays
MLQVEEALAAVLSAAAGHAEPHAVPLQGALGLVLAEDVCAPDPLPPFRASIKDGYAVVASDGPGEYPVVTESRAGDDALGVVVVPGTVAYVTTGGPVPDGADAVVQVEDTEQLPGGADGSKRVRILARASQRQDIRSVVCKVWSLHGY

SEQ ID NO: 17654 - protein, 188 aa, Neisseria meningitidis MC58
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 17655 - protein, 239 aa, Brassica oleracea var. botrytis
RGRVQLKRIENKINRQVTFSKRRSGLLKKAHEISVLCDAEVALIVFSSKGKLFEYSTDSCMESILERYDRYLYSDKQLVGRDISQIENWVLEHAKLKARVEVLEKNKRNFMGEELESLSLKDLQSLEHQLDAAIKSIRSRKNQAMFESISALQKKDKALQDHNNTLLKKIKEREKKTGHQEGQLNHCSNNSSIVQPQYCLTSSRDGFVGRVGGENGGASSLTEPNSLLPAWMLRPTTNE

SEQ ID NO: 17656 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGERYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLRSIEHRAMTNSVLARTSVATFIMPTQECLIGPAKEFLSEENPPCYRTIMFRDFMRIYNVVKLGSSLNLTTNLKNVQKEI

SEQ ID NO: 17657 - protein, 268 aa, Gossypium raimondii
GAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNMPTSVSKSSSIKNPSLDFNYNEFQFKSNTDSLEEPNCTASSGMTTDEEQQEQLHKQQQYDPSNGQDLNLELSIGIVSADSSRVSSANSAESKPKVDNNNFQFLEQAMVAKAVCLCWQLGFGTSEICRNCQNSNS

SEQ ID NO: 17658 - protein, 210 aa, Petunia x hybrida
AHEMSMLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 17659 - protein, 306 aa, Lactobacillus gasseri
MIQLEQLVQKNLAKEKEGKVASYIPALAEVNPKQLGVALYDLDDGEIGEAGQSEVRFAIESISKVITLMLAIKKMGIQEVFKHVGSRQTGFAFNSILNMEIEKAKYPLNPFINAGAIATTSMVVSKTGEGAFEEILSFARDICNDPNLYLDQIIYHSERRTGNLDRSLAYYMESKNMMLGDVVTSLDTYFKQCSMMVTAHSLANLGAVLANGGVKPWDNKRIISDEEARCVKSLMMTTGLYNQSGTYSRLIGVPTKSGVGGGLMSAAPHKYGIGIFSPALDKAGNSVAGLDLLRDIVEGLELDIFD

SEQ ID NO: 17660 - protein, 122 aa, Glycine max
  unsure (1)..(122): unsure at all Xaa locations
PAPYFALLCIHKIQETDEARRKFSNAKSISSSQFFGDQKQSXDVDSQATLSKFSGSSAISSADLFGDSRDNNIDLTAGDLINRLSFQAQQDLSSLKNIAGETGKKLSSLASTLMTDLQDRIL

SEQ ID NO: 17661 - protein, 692 aa, Cytophaga hutchinsonii
MSIPEDKKKKKSPIPNPSQKTNYQIFLISALLLVVVGIAYFSGSGGIQKTTKQRFFDMVLQHDVKKIVLVNDRNVEVTITDEALKSGRYDELLKRTNSPFSGTATGPQFQFEITPSYDFEAKYEEFLNKEKVPKEYQVPIEVDSNRAEVTSQLVTLGFWVLLFVGTWFLFRRVSGGGAGGQIFNIGKSKAALFDQDNKVKITFADVAGLDEAKEEVKEIVDFLRFPTKFTKLGGKIPKGALLVGPPGTGKTLLAKAVAGEAGVPFFSLSGSDFVEMFVGVGAARVRDLFKQAKEKAPCIIFIDEIDAIGRMRGKGGNMPGSNDERENTLNSLLVEMDGFGTDSGVIILAATNRPDVLDSALLRPGRFDRMISIDKPDIVGREQIFKVHLKPLKLGPDVDPKKIAAQTPGFAGAEIMNVCNEAALIAARRDKSEIDMQDFQDAIDRVIGGLEKKTKIISPEEKKIVAYHEAGHAVAGWFLEHADPLVKVSIVPRGVAALGYAQYLPKEQFLYTVEQLTDEMCMALGGRAAEDIIFGKISTGALSDLERITKMAYGMVSIYGMNDKIGNISFYDSKAGDYSFNKPYSESTAQTIDEEARNIVHEAYNRTKKLLLEKQPELEIVAKQLLEKEILFQSDLEKLIGKRPFEAETTYQAFTNKVDAPETLPDIIPNPAQQEGNSGSSTYSTNEGTYNK

SEQ ID NO: 17662 - protein, 380 aa, Mycobacterium tuberculosis H37Rv
MTRSGHPVTLDDLPLRADLRGKAPYGAPQLAVPVRLNTNENPHPPTRALVDDVVRSVREAAIDLHRYPDRDAVALRADLAGYLTAQTGIQLGVENIWAANGSNEILQQLLQAFGGPGRSAIGFVPSYSMHPIISDGTHTEWIEASRANDFGLDVDVAVAAVVDRKPDVVFIASPNNPSGQSVSLPDLCKLLDVAPGIAIVDEAYGEFSSQPSAVSLVEEYPSKLVVTRTMSKAFAFAGGRLGYLIATPAVIDAMLLVRLPYHLSSVTQAAARAALRHSDDTLSSVAALIAERERVTTSLNDMGFRVIPSDANFVLFGEFADAPAAWRRYLEAGILIRDVGIPGYLRATTGLAEENDAFLRASARIATDLVPVTRSPVGAP

SEQ ID NO: 17663 - protein, 353 aa, Mycobacterium tuberculosis H37Rv
MTARLRPELAGLPVYVPGKTVPGAIKLASNETVFGPLPSVRAAIDRATDTVNRYPDNGCVQLKAALARHLGPDFAPEHVAVGCGSVSLCQQLVQVTASVGDEVVFGWRSFELYPPQVRVAGAIPIQVPLTDHTFDLYAMLATVTDRTRLIFVCNPNNPTSTVVGPDALARFVEAVPAHILIAIDEAYVEYIRDGMRPDSLGLVRAHNNVVVLRTFSKAYGLAGLRIGYAIGHPDVITALDKVYVPFTVSSIGQAAAIASLDAADELLARTDTVVAERARVSAELRAAGFTLPPSQANFVWLPLGSRTQDFVEQAADARIVVRPYGTDGVRVTVAAPEENDAFLRFARRWRSDQ

SEQ ID NO: 17664 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 17665 - protein, 441 aa, Oryza sativa
  unsure (1)..(441): unsure at all Xaa locations
MWPAAAASLHVLVLPPLPPPGCRTRRAAPVLARRGRGVRHAARRDTPPNPVDAVDCVGTGADVECYVDDRPGAEVGPIRREATPPPSPQDAVDCVGTGTDVECFVDGPGAGAGVGAEPLLARVSEEEEDGVSASAAALVGREWWEWASLVSPFFFWGTAMVAMKGVIPKTGPFFVAALRLLPAGALLVAFAAARGRRQPSGWAAWVAVAAFGLVDAACFQGFLAEGLQKTSAGLGSVIIDSQPLTVAVLAALLFGESIGAIGVGGLVLGVVGLLLLEVPALSVEGNDTAIWGSGEWWXMFLSAQSMAVGTIMVRWVSKYSDPIIATGWHMIIGGLPLLVISVLNHDPXLNGHLQELTLNDVLSLLYTSIFGSAISYGVYFYNATRSSLTTLSSLTFLTPMFASIFGFLYLGETFSPVQLGGALLTLVAIYMVNYKSIVGEK

SEQ ID NO: 17666 - protein, 502 aa, Petunia x hybrida
MEIQLSSLVPFLLFLSSIFLLLRKWKTQELNLPPGPWKLPFIGSLHHLVFAGPLPHHGLTNLAKRYGPLMLLQLGEQPTVFISSPQMAKEVLKTHDLAFATRPKLTFAEIIKYGSTDIAFSPYGEYWRQIRKICVMELLSAKMVNSFSSIREDELSNMISWIRLRPNIPVNLTEKVKWFTSSVVCRSALGKICKDQNKLIILMREILSLAISVNFADFFPRWKFLHDLGGSKTRLLKEHHKIDEILQDIVNEHKQNRVNGKMGNGEFGGEDLIDVLLRVRESGQHQLPITDDNIKAVIVDMFSAGTETSSTTIIWALAEMMKKPSVLAKAQAEVRQAMKGKKGFQLIDLDELKYLKLVIKETLRMHPPIPLLIPRECMEETKINGFNIPLKTRVIVNIWAIGRNPESWEDPESFMPERFENNPIDFTGNHHQFIPFGAGRRMCPGMLFGLTNVAQLLAQLLHHFDWKLPNGQSPQDLDMTESPGVSATRKDDLVFVATPYDS

SEQ ID NO: 17667 - protein, 200 aa, Methanosarcina barkeri
MKVVFINNKDSFVWNLVDYISYFEKDTLVLPNTVSLEELRKIKPDALVISPGPGNPSDPRDIGNCLEIIREMGREIPLLGVCLGHQAINVAFGGAVRRSKVGPVHGKSSKILHEDSALFSAFQGPFEAGRYHSLEIGEPAPGIKVTARAEDGSIMAVEHVKYPIYGLQFHPESVLTPNGLKIIESFLEISKNYKKRQPAV

SEQ ID NO: 17668 - protein, 238 aa, Magnetospirillum magnetotacticum
MRFEVAPASEGPATARCFILVTPDGERTMNTYLGACQALSPDDVDEATVRAARVTYLEGYLWDPPAAKDAFRKAVKIAHSAGNAVALTLSDAFCVGRYREEFLELIRNGSIDIMFANIGELQSLYQTDDPEAAIAALRDERDAQGKHMLGLVTRSAEGALVVRGGEVRSVEAFPAREVIDTTGAGDLFAAGFLAGYTRGIDYVASARLGALAAAEVIEHIGARPQRDLLALAREHKLV

SEQ ID NO: 17669 - protein, 367 aa, Oryza sativa
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEEIMILPVGAKNFEEAMQMGSETYHHLKDIILEKYGSNSCNIGDDGNKYDMEFKFAEKSGQGFKTADDLIEIYSQLCSEYPLVSIEQPFDKDDWEHSKKFTTLELCQANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 17670 - protein, 506 aa, Pseudomonas syringae pv. syringae B728a
MRYAHPGTEGAIVNFKERYGNYIGGEFVAPVKGQYFTNTSPVTGKAIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPLLMAAWKLAPALAAGNCIVLKPAEQTPLGISVLIELIGDLLPPGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLDIAKGEGAELLTGGKVEKLEGSLSTGYYIQPTLLKGNNKMRVFQEEIFGPVVSVTTFKDEAEAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 17671 - protein, 148 aa, Listeria monocytogenes
ITYLFSDEGTPASYREIRGSSVHAFKWINEEGKTVYVKLRWVPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGM

SEQ ID NO: 17672 - protein, 660 aa, Oryza sativa
MQPRATSQQVLLQQGVKNRRALDSHEAEVPQRERSKDIRGSGSASLLSRKPKRFQLGKSKMRSCSWRGEEEEEEEMQELLRGNKDVMSLAQGVVYWQPPEAAMNKIKEIVWEPSISKYGSDDGLPELREALLEKLRRENKLTKSSIMVTSGANQAFVNVVLTLCDAGDAVVMFAPYYFNSYMSFQMTGVTDILVGASNPETLHPDVDWLEKVLQENNPIPKLVSVVNPGNPSGAFIPKPMLERISELCRNAGAWLVVDNTYEYFMYDGMEHYCLEGNHIVNLFSFSKAYGMMGWRVGYIAHPNEADGLHAQLLKVQDNIPICASIIGQRLALYALEAGPEWIRERVRDLVKNRELLMEAMSPLGKDSVKGGEGAIYLWAKLPEKCSDDFEVVRWLANKHGVAVIPGSASGGPGYIRVSFGGLKESDTRLAAERLRRGLQELVTEGMHFSTTCSEDAGSKFSQPLLVPIIKPNQPHLGCIPKCRWMLLKLSLRHNYSKVYTNELNITKLINILILKEFSKNANSRRRLRPHLNLLKMDIKYGHVKKRCWPCVSIAAAIVESMHCVRIYNGPKCKLQLQWPWPWSREGEREMRLLTCFADDHRRFDEAETTNGQYSVRQKKMMNLDTQEYVRQPTAAVAPHTDEDNVCPRSVEWNGGISLLK

SEQ ID NO: 17673 - protein, 620 aa, Escherichia coli O157:H7
MDSHTLVQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYICLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 17674 - protein, 304 aa, Fusobacterium nucleatum subsp. nucleatum ATCC 25586
MKELLKELVEKNRKFTADGNVANYIPELDKADKNALGIYVTTLDGQEFFAGDYNTKFTIQSISKIISLMLAILDNGEEYVFSKVGMEPSGDPFNSIRKLETSSRKKPYNPMINAGAIAVASMIKGKDDREKFSRLLNFAKLITEDDSLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGHLLEDLSAELSLNIF

SEQ ID NO: 17675 - protein, 170 aa, Zea mays; identical to SEQ ID NO: 2818

SEQ ID NO: 17676 - protein, 420 aa, Neurospora crassa
MNPTWVMSFPDGNETGTYLALDMGGTNLRVCQVTLTETKSEFDIIQSKYRMPEELKTGDAEELWEYIADCLMQFIETHHGDPTKLDALPLGFTFSYPATQNYIDEGILQRWTKGFDIAGVEGHNVVPMFEAALQRRVGCTLIASAYTDPKMRIGCIFGTGCNAAYMENCGSIPKLAHMNLPPDMPMAINCEWGAFDNEHKVLPRTPYDVIIDKDSPRPGQQSFEKMVAGLYLGEIFRLVLVDLHDNQEIKIFPGQDIAKLRKAYNWQLTNTCRDPFENLSETFELFQTKLGLTPTGPELELIRRTAELIGTRAARLSACGVAAISKKKGYKQCHVGADGSVFNKYPNFKARGAQALREILDWPEKADPKEDDPIEILAAEDGSGVGAALIAALTMQRIKQGNMHGILHPENFRTTEPLPA

SEQ ID NO: 17677 - protein, 336 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 17678 - protein, 350 aa, Candida albicans
MSEQIPKTQKAVVFDTNGGQLVYKDYPVPTPKPNELLIHVKYSGVCHTDLHARKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 17679 - protein, 581 aa, Schizosaccharomyces pombe
MNYRRNICLRIGWMLLFAFIPAYAGHSAEEWKRRSIYQIITDRFSLEEGATERIPCDPVRFMYCGGTWNGIRNHLDYIQGMGFDAIWISPIFENVEGNDIDGSSYHGYWTTNLYELNHHFGTKEEFMELIQELHKRDIWILLDVAINSMAINGPLEQMSFEKVIPFNDASFFHPHCWVDYESNDIESVQNCWLGDENLLLADVDTENEVVLSVLEKWIKNVVQEYDIDGIRFDAIKHAPIEFWLRMSKAADIFTIGEYFTGSPAEACDYQNSGLDSFLNFPLYWPITWAFNNTGLQCEALAIAINQINEECNDINVLGTFIGNHDLPRISHNNTDQARIMNAITFVMMWDGIPIIYYGTEQNFNSYHDPFNREALWLSNFDMENVYYKLIGILNRFRKSVQRQEENYVNTRSTILSVKIHHIVVQKLNVITVLNNYGIHNEERLSIVFKPLGASPKDTFFDIINNQKYVVNTDGTLKVVITNGFPIVLYPTSKIETSLPQFTATLLPEITFVPSITVTTHYVLPTLLAPLGYDIREHPGGQQFWNTLTAKSEAKTIRSFTKLKLFILLIAVPFALPMIILI

SEQ ID NO: 17680 - protein, 174 aa, Zea mays
  unsure (1)..(174): unsure at all Xaa locations
MAAKRELVVSFGEMLIDFVPTVAGVSLAEAPAFVKAPGGAPANVAIAVARLGGGAAFVGKLGDDEFGRMLAKILRDNGVDAGGVVFDSGARTALAFVTLRADGEREFMFYRNPSADMLLTADELKVDVIKRAAVFHYGSISLIAEPCRTAHLHAMKVAKERXPRLLSYEPNLRE

SEQ ID NO: 17681 - protein, 458 aa, Gelidium crinale
  unsure (1)..(458): unsure at all Xaa locations
PDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDXNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 17682 - protein, 490 aa, Oceanobacillus iheyensis HTE831
MKLYENLNKNFISGEWRDGQGETTYEVKNPYNDEVLQEIKMASKEDIDEAYKSAEQAKKKWAKFNPFERSSIMEKAVQIIDARREEFVNHLIREGGSSHLKANVEIDFVIAITREAASFPLRMSGEIVPSLIPGKENRIYRSPLGVVGVIGPFNFPMYLAMRSVAPALAVGNGVVLKPDDQTAVTGGILLAKVFEEAGLPKGVFNVVVPNIEDIGDAFVEHPIPRLISFTGSTPVGRHIGEICGRNIKKVALELGGNNPLVVLEDAKVENAVNSALFGKFMHNGQICMAINRIIVHKDIYEEFVEKFVEKAKKIKVGNPSEKDNLIGPLINRQAIDRILEQIESAKEQGAEVVLEGKVEGNVMHPYILTGSNDVATAQNEMFGPVATIISAESDEEAIRIANDTPFGLSGAVHAGSPERGVEVAKQITSGMVHVNDQSVNDEPLIAFGGEKASGLGRFGGKWSLEEFTTVQWISVQTEERENPFHTDYLE

SEQ ID NO: 17683 - protein, 564 aa, Magnetococcus sp. MC-1
MRLTGAEIIVQCLLEQGVKTVFGYPGGAVLNIYDEIYKCKDLQHVLGRHEQGLLHAADGYARVTGEVGVALVTSGPGATNAVTGLATAYMDSIPMVCITGQVPVALIGNDAFQEADTVGITRSCTKHNYLVKDVKDLARVLREAFYIARTGRPGPVLVDIPKDITIAATEYSPAKGEVSIRSYKPSISGHTGQIRKAAGLMAKAKRPLFYTGGGVILSNAAEELTQLVRKLGAPITNTLMGLGGFPCTDKQFVGMLGMHGTYEANMAVSRCDLLVAIGARFDDRVTGKISQFAPEAKIIHLDVDPTSISKNVEVDVPIVGDIKTVLGKMLAMMEDGKYQSELPDLGDWWAEIEQWRRKECLKFTQGDEVIEAQYVIQKLYELTKGNAIVATDVGQHQMWAAQFYGFEKPRRWLTSGGLGTMGYGLPAAIGAQMAFPHETVVLITGESSIQMNIQELATLKQYNLPVKIAILNNSFLGMVRQWQELFYERRYSESDMTVHPDFVQLAQAYGATGMMTARPAEVSGIIEKALAIDGPVLMDFRVNREANVYPMVPAGAALNEMILL

SEQ ID NO: 17684 - protein, 681 aa, Glycine max
  unsure (1)..(681): unsure at all Xaa locations
VTISFDENETVIIVNHNNNSKSFILGSVSSSSSSSPSPFSDNSADXLHLSSQKNFSTVSKPGGASASGSPGKPPESNGTLSKFFIGSVALGAAFLAAYQTHYLDQYLKKEHYSVLQEPHVNAITEQKIDAHFSHPEIVVEDQVDKPIPVQDKSDIAEDVTAAAKENQLPEYPESSLTSDDPSKESVTQSDGIIGIQSTETVNARMEEGYHHASTSTQTSPDENGMKNIQPEQLEIQEMGRREVLMNLQQPTLLEEYHLRNKSERSPATYISSHALNGAMEELKDGYISENGKLVLDFLQAIHAAEKRQADLDAHAFNEEKKVLKLLMNDELXNLYFYLKLCSCXEKYEKKLKDAAARELMLAEEAAMLDRELKRERAKASLAIKSLQEKMEEKLKTELEQKEIETDLKFKQTQELAKAELNAAIANEKAAQIEKMAEANVNVRFLLKSKMDFSSFLXINALCMAFYARSEEARQSHATQNFALRALALEDALSKGLPIETEIASLQSYLGSTDKDSVLDLVLASLPEETRSNGTDTQLQLKQKASCVLLCIXLYMDYFLISVSNLCILLQFDALKGSVRHFSFFPPGGGGMLAHSLAHVASWLKVREDNQSGDGIESVINKVEVYLAEGKLAEAAACLEESVRGTQAAEIVAGWVRQARNRAISEQAVLLLQSYANSLSFT

SEQ ID NO: 17685 - protein, 509 aa, Oryza sativa
MCPLFERLLRKLRSISPIIWSRSLSPGARLDSFLFLFFCVKALRKDITGGRIKGLCYAHTPEDPRVDFIGCLVIQVWQVKGLGQNGPRKCWAVSGRHGYCCMDRWPTHLQENVIRVKLQSQVFYSREGSKPSPCSASDPRRPPPPSQPSQQQQEEEGSGGGCRRPMSSSLASRRSSSSSAAKRPAAGEGGGKAAAGAAAAKKRVALGNITNVAAAANNAKFNSATWAAPVKKGSLASGRNVGTNRVSAVKSASTKPASAISRHESAPQKEASVSVDETMSTCDSMKSPDFEYIDNGDSSSVLGSLQRRANENLRISEDRDVEETKWKKDAPSPMEIDQICDVDNNYEDPQLCATLASDIYMHLREAEVAEEYRLVPDTLYLTVNYIDRYLSGNEINRQRLQLLGVACMLIAAKYKEICAPQVEEFCYITDNTYFRDELFIVQDPALHLEFLANYVAELSLLEYNLLSYPPSLVAASAIFLAKFILQPAKHPWIYAADVIDLNMMIQRDS

SEQ ID NO: 17686 - protein, 190 aa, Griffithsia japonica
ARGTGGVYATAERCAVTTTLAGATGGVVTLIVIKIRDHIFDLLACLNGILAGLVAITACCAFVDPWAAVVIGAIGAVVYIGAAMLLLKFQIDDPLEAFPIHGASGAWGCLAGTLFNKQGHQVTAGFTDQIWGLFYGGGGRLLGVNALGMVVITVWTVGLVTPLFLVMKFTGILRISPEEEIIGNDVSKHG

SEQ ID NO: 17687 - protein, 444 aa, Spinacia oleracea
NSQTCLDPEASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPDWFQGTADAVRQYLWLFEEHNVMEFLILAGDHLYRMDYERFIQAHRETDADITVAALPMDEKRATAFGLMKIDEEGRIIEFAEKPKGEQLQAMKVDTTILGLDDERAKEMPYIASMGIYVISKDVMLNLLRDKFPGANDFGSEVIPGATSIGLTVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKLLAAKGSVVLGIGQNSHIKRAIIDKNARIGDNVKIINSDNVQEAARETDGYFIKSGIVTVIKDALIPSGTVI

SEQ ID NO: 17688 - protein, 455 aa, Methanosarcina barkeri
SFEFEEVELIVREELGHSIEELFECFEKKPLACASIGQVHRAKIKDGDEVVVKVQRPGIKEVIESDLDIMYSIARLIDEHMPEARLYRPIELVDELSRSILAEIDYTQEGWNADRFAENFRENSQVHIPRVYWDYTNTRVLTLEYIKGIKSSRVDLLDRQGFDRSNIASVVIEAFMQQVFEDGFFHADLHPGNILIMEDGTVAFLDFGMAGHLSSEVCDIFLDGMVALVNGDSSLFVELLRDMGCIDSYADTRSLKEDVESFRSKYYGKALKKLDASTIIEELIGILRDHQVTMPHNIALLVRGIVAVEGFGLITDPDLNFSELLEPYAKNELKKRFYPQNLAHKAYSNISNWTRLFRKAPNKISHILDHAENGYLNIKFESEEGKKLVSEIDVASNRLSISLIISAMIVASSLVIQTHMRPLVWGVPFLGTFSFVIASIFGLWLIYNIFKTGRI

SEQ ID NO: 17689 - protein, 488 aa, Cyanidioschyzon merolae
MAQSVQERTRLKNKRYESGVIPYAKMGYWNPNYVVKDSDMLALFRVTPQPGVDPIEAAAAVAGESSTATWTVVWTDLLTACDVYRAKAYRVDPVPTAPDQYFVYIAYDIDLFEEGSIANLTASIIGNVFGFKAVKALRLEDMRIPFSYLKTFQGPATGVIVERERLNKFGRPLLGCTVKPKLGLSGKNYGRVVYEGLKGGLDFLKDDENINSQPFKRWRDRYLYVMEGVNRAAAASGEVKGSYLNVTAATMEECYKRAEFAKEVGSVIIMIDLVIGYTAIQTMAIWARENNMILHLHRAGNSTYSRQKNHGINFRVISKWMRMAGVGHIHAGTVVGKLEGDPIIIKGFYNTLLLPKLEVNLPQGLFFEMDWASLRKTLPVASGGIHAGQMHQLLHYLGEDVVLQFGGGTIGHPDGIQAGATANRVALEAMVLARNEGRDYFNEGPQILRDAAKNCGPLQTALDLWKDIAFNYTSTDTSDFVETPTANV

SEQ ID NO: 17690 - protein, 334 aa, Geobacillus stearothermophilus
AVKVGINGFGRIGRNVFRAALKNPDIEVVAVNGLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 17691 - protein, 366 aa, Methanosarcina barkeri
MFLSRPELIKKEIFDIAEYVPGKSIEEIASAYGLDPASIIKLGSNENPLGPSPKAVQAMMDTAPFANIYPSADAIELREALSRYTGFPVSNLIASGPGMDGLLDGLCRLVIEKGDEVIVPTPTFAYYELPARACGGKPVFVRRSQDFSIDPEKLLEATSSRTKIIFLCSPNNPSGNLLPEKDLRKVLENTRALVFVDEAYVEFADRNLAELVREYDNLVVGRTFSKVFGLAGLRLGYGIMPEWLAKEYIRAATPFSVSLPALKAGIAALSDVEHRKKSIEIAREGRKYLKEKIPFKVYPSQANFVLVDVSPLKAKAVTQSLMKKGIIVRSCDSFRDAGDTLIRATAGTLEQNEKVVRAFETAKKEV

SEQ ID NO: 17692 - protein, 273 aa, Oryza sativa
MAGIRWPPEDPEIFPSRMVTGGGGGGAGGGPPGPPGEMASDDDRSVAADSWSIKSDYGSTLDDEQRYADAAEVLLASSSSSSAAASGPAAATTASVAANPSGDFSFDKDVPDSADMEPPLLGLPNYHQDGSYAEYLANFQERSHTDDWFSDLTGIDHSEGAIEVARNLAIRDGFEHINFLVDDVLESKLERRFELVMDEGTLDTIGLHPDGPVKRTKDELVQEVESFNQRKLSAMGSEGAQASDTAVFKYIDHVQTYPIVDSSCITTVAFSHS

SEQ ID NO: 17693 - protein, 83 aa, Daucus carota
WPMAKLGFEDYIEPLKVYLARYREMEGDTKGSGKGAEGSSRKEGVQPVHQGQLVHQGSYPQGVIYGNSQQQTQHMMVPMQGPQ

SEQ ID NO: 17694 - protein, 295 aa, Coxiella burnetii RSA 493
MKKVTTAVFPVAGLGTRFLPVTKAGPKEMLPIVDKPIIQYVVEEAIAAGITHLVFVTSSSKRAIEDYFDSNYELETRLRSSRKLDALKLIQNLLPKEVRISYVRQAHPLGLGDAVLSAKHVVGDQPFAVLLPDDIIDCGEKSCLQLMMEAFEKHQRNIIAVEQVPLNQTDKYGIVSVVDEHQVKRITGMVEKPPLGSALSDWAVTGRYILSPRVFDHLDAISCGVGGEIQLTDAIVALLQEEQVLAFPFKGHRYDCGSRLGFLQATIAYALKRPEFKEPLREYLFKLLGSECVGG

SEQ ID NO: 17695 - protein, 131 aa, Pectobacterium carotovorum subsp. carotovorum
LVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAA

SEQ ID NO: 17696 - protein, 333 aa, Zea mays
MKTTSSHGLHAASASLCTPYLLLLPLGLLAVLLALPSLGSSYARSQGLGVLCRSAAAGTDGGGGGDYSSSVASGAGDEKKAAVAETPPPPPPGPELSLLVGVLTVPGRRERRDILRTAYALQPAAPASRVDVRFVFCSVTDPVEAALVAVEARRHGDVLVLDCAENMNDGKTHAYLSSVPRLFASAPYDYVMKTDDDTYLRVAALVAELRPRPRDDVYLGYGFPVGDDPMPFMHGMGYVVSWDVARWVSANGDILRHNDTHGPEDLLVGKWLNIGGRGRNRYDLKPRMYDLNWFMDNFRPDTIAVHMLKDNRRWAATFTYFNVTAGIHTNSLP

SEQ ID NO: 17697 - protein, 297 aa, Streptomyces coelicolor A3(2)
MDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 17698 - protein, 230 aa, Helicobacter pylori J99
MALYDRANSRNAYAEDSVLHESELVSFVKTTYKFFAGSLLLATVGALLGLMNFQAVVQYKWVFFIAEIVAFFGLMFSKSKPGLNLFMLFAFTSLSGVTLVPLLGMVIAKAGLGAVWQALGMTTIVFGLMSVYALKTKNDLANMGKMLFIALIVVVVCSLINLFLGSPMFQVVIAGASAILFSLYIAYDTQNIVKGMYDSPIDAAVSLYLDFLNVFISILQIIGIFSDRDK

SEQ ID NO: 17699 - protein, 324 aa, Pseudomonas aeruginosa UCBPP-PA14
MSTLSTDQLLHAYRVMRTIRAFEERLHVEFATGEIPGFVHLYAGEEASAAGVMAHLRNDDCIASTHRGHGHCIAKGVDVHGMMAEIYGKKTGVCQGKGGSMHIADLEKGMLGANGIVGAGAPLAAGAALAAKLKGSDAVAVAFFGDGGSNEGAVFEAMNLAAVWNLPCLFVAENNGYAEATAANWSVACDHIADRAAGFGMPGVTVDGFDFFAVHEAAGAAIERARAGEGPSLIEVKLTRYYGHFEGDAQTYRDPDEVKHYRETRDCLKQFRERTCHAGLLSASDLDAIDAEVEARIEDAVQRAKNDPKPEPDDLLRDVYVSYP

SEQ ID NO: 17700 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 17701 - protein, 308 aa, Glycine max
RKRGVFSEEIKLLKEKYEKKLKDAAARQLMLAEEAALLDRELKRERAKASLAINSLQEKMEEKLKTELEQKEIEAELKLKQAQELAKAELNAAIANEKAAQIEKMAEANVNINALCMAFYARSEEARQSHATQNFALRALALEDALSKGLPIETEIASLQSYLGGIDKDSILDLVLASLPEETRSNGTDTQLQLKQKFDALKGSVRHFSFFPPGGGGMLAHSLAHLASWLKVREDDQSGDGIESVINKVEVYLAEGKLAEAADCLEESVRGTQAAEIVAGWVRQARNRAISEQAVLLLQSYANSLSLT

SEQ ID NO: 17702 - protein, 464 aa, ASPERGILLUS NIDULANS FGSC A4
MGHSPVTVKADADPEQNSDQLVQKPVSRLTRWYRSALFNVIIVGLISFTQPGIWNALNNTGAGGQQKPYLVNGANSLTFGIMVFGCPLFSILANRYGLRRVLILGTLGYAPYSASLYVNNRYGTEWFVLFGGATCGIAASALWSSEGAIALGYGGVRDRGKNTGIWLGLRELGQLIGSSIQLSLNVKDGERGKVGYSTYLVLIALQCLGLPLALLISHPSKVIRSDGSSIPDPTRQKAVLGEFRKLWAQVKKKHILLLIPILVGFNWNSTYQGIYLTNYFSVRARTLGSLTSGISATAANMFWGWFFDTQYLSRPKLARITWFTFATIMLALFGWQFANEKLYDDTQPTIDWAQPNFGRGFAVNVLFRFMNESHYMFVYWILGVFNDDLETLTLTVGIVRCFESVGSCLAFGIGAAKVSPMVNLIVAFVMFVLCIPSTSWVVFMVPEHPETTPKDDESSQEPRR

SEQ ID NO: 17703 - protein, 243 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 17704 - protein, 99 aa, Zea mays; identical to SEQ ID NO: 3237

SEQ ID NO: 17705 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQPRGGAESESEPSPAPAQANRGNLPPWMLRTVK

SEQ ID NO: 17706 - protein, 340 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDEKKLFGVTTLDVVRAKTFYAGKAGVPVTGVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 17707 - protein, 490 aa, Odontella sinensis
MSQSVSERTRIKSDRYESGVIPYAKMGYWDASYTVQDTDVLALFRITPQPGVDPVEAAAAVAGESSTATWTVVWTDLLTACERYRAKAYRVDPVPNTTDQYFAFIAYECDLFEEGSLANLTASIIGNVFGFKAVAALRLEDMRIPYAYLKTFQGPATGIVVERERLNKYGAPLLGATVKPKLGLSGKNYGRVVYEGLKGGLDFLKDDENINSQPFMRWRERFLYCLEGINRASAATGEVKGSYLNITAATMEEVYKRADYAKQIGSVIVIIDLVMGYTAIQSAAIWARDNDMLLHLHRAGNSTYARQKNHGINFRVICKWMRMSGVDHIHAGTVVGKLEGDPLMIKGFYDVLRLTTLDVNLPYGIFFDMSWASLRKCMPVASGGIHCGQMHQLIHYLGDDVVLQFGGGTIGHPDGIQAGATANRVALEAMVLARNEGADYFNPQVGPQILREAAKKCGPLQTALDLWKDISFNYTSTDTADFAETPTANV

SEQ ID NO: 17708 - protein, 78 aa, GIBBERELLA ZEAE PH-1
MHCGPDYPDLPPTIQFISQVNLPCVNPNNGVVDPSQLPCLAQWKRENTMETVLIELRRYMASSQNKKIPQPPEGSTYP

SEQ ID NO: 17709 - protein, 345 aa, Bacillus anthracis str. A2012
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQNNCDCK

SEQ ID NO: 17710 - protein, 788 aa, Triticum aestivum; identical to SEQ ID NO: 6897

SEQ ID NO: 17711 - protein, 157 aa, Glycine max
MGLSSKQVSSSGLDWKQTLLEAQNLELPKPNLMRKQQQQQQQQQQQTQPNSESLKCPRCDSTNTKFCYYNNYNKSQPRHFCRACKRHWTKGGTLRNVPVGGGRKNKRVRKSITTPITTSSTTTHQSQPPLQLALPQSQPQLATTTTTWMLCWVVIAT

SEQ ID NO: 17712 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 17713 - protein, 490 aa, GIBBERELLA ZEAE PH-1
MASPKLSDPSLIKNACYVNGQWVAAKSGKDFSVENPASLEKLGSCPEFDANDTEAAIAAADAAYKTYRKTPARQRARYLRRWYDLMMENADDIARLITLENGKVWSDAKTEAVYAANFFEWFSEEAPRIYGETIEASNPSCRLSTIKQPVGVCGLIAPWNFPAAMITRKAGPALAAGCTVVIKAPAEAPLTALALAELAHRAGIPAGVVNIITALDNTAEVGKVLTTHPKIKKVSFTGSTGVGRLLMNQSSSTVKKLSFELGGNAPFIVFEDADLEKAVKGIITSKFRNSGQTCVCANRIFVHRSIYDKFVQMVLDVVKTFVIGDGFGEKTTHGPLIHGRAVAKTAEHVEDAISKGAKLIHGGERLADLGPNFFGLTMLTDMTPDMKIFSEETFGPVAAFFAFDTEEEVIELANDSEVGLGGYFFSENVNRCYRVAEALEVGMIGVNCGVLSDPAAPFGGIKQSGFGREGSKYGIDEFTVTKMVMTNIDP

SEQ ID NO: 17714 - protein, 766 aa, Magnetospirillum magnetotacticum
MASNFHSEVSRNADSKGTDALERDTLLMHSSGRPGKIEVVPTKPLATQRDLSLAYSPGVAFPCLHIARDPSLAYDYTAKGNLVAVISNGTAVLGLGDLGALASKPVMEGKAVLFKRFADVDSIDLEVDTRDVEEFIAAVRYLGPSFGGINLEDIKAPECFIIEQRLRELMPIPVFHDDQHGTAIISAAGLINALDLTGRDISTVKVVVNGAGAAGIACIELAKAMGVRHENVTLCDTKGTIYQGRTEGMNQWKSAHAVPTKARTLAEALEGADVFYGLSVKGAVTPEMVASMAPRPIIFAMANPDPEITPEEVKSVRSDAIVATGRSDYPNQINNVLGFPYIFRGALDVRASTINDSMKIAAARAIAALAREDVPDEVDAAYSGRRLRYGPDYIIPVPFDPRLIASIPPAVAKAAMDSGVARKPIIDMGAYKRELSARLDPASAGMQTITEAVKANPKRVVFAEGEEEKQIRAAVAFANAGLGHPILLGREDRIRETMKNIGLPAAESLDIINSRISPRTKAYTDMLYARLQRRGALYRDVQRLVNQERNIFGSLMVQSGDADAMVTGLTRNYWQAFEEIKKVIDPTPGELLFGMTVFVVKGKLVFMADTTVMETPTPQQLADIAVQTAHKARQMGHEPRVAMISYSNFGNPSNERADRVREAVGILDSRKVDFVYDGEMAADVALDPDLLSHFPFCRLKEPANVLVMPGLYSATIASKLLQKLGGVSVIGPILVGLSKPVQITSMDATANDIVNMAVLASYDAVR

SEQ ID NO: 17715 - protein, 424 aa, Grateloupia divaricata
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMPMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVIARNEGRDFVTEGPQILQDAAKTAAEQPS

SEQ ID NO: 17716 - protein, 294 aa, Escherichia coli O157:H7
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLADAFGPKDLEIKTLLMDEQDHGYALTGDALSQAAIAAANRSHMPYSKSPSGVALECKDGRIFSGSYAENAAFNPTLPPLQGALILLNLKGYDYPDIQRAVLAEKADAPLIQWDATSATLKALGCHNIDRVLLA

SEQ ID NO: 17717 - protein, 298 aa, Klebsiella pneumoniae
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKLLA

SEQ ID NO: 17718 - protein, 318 aa, Musa acuminata
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 17719 - protein, 759 aa, Schizosaccharomyces pombe
MSEKVDVGESVKGDASENAVKEVAERPIVMIDNYDSFTWNVVQYLSNLEKRYPIMVFRNDEITVDELEKLNPLKLVLSPGPGHPARDGGICNEAISRFAGKIPILGVCMGLQCIFETMGGKVDSAGEIIHGKVSKINHDGLGFYQGIPQNISVTRYHSLAGKISSLPDCLDVTSWTENGVIMGARHKKYAIEGVQYHPESILSEYGKEYIQNFLNLTAGTWEENGIVMPTKNNAFNAAMRENSNSVSSTKIRKQESILEKIHAQRLIDIAESKRKPGLSVGDLQTYLNLNIAPPCINFYERLKQSKPALMAEVKRASPSKGDIKLDANAAIQALTYAQVGASVISVLTEPKWFKGSLNDLFVARKAVEHVANRPAILRKDFIIDPYEIMEARLNGADSVLLIVAMLSREQLESLYKFSKSLGMEPLVEVNCAEEMKTAIELGAKVIGVNNRNLHSFEVDLSTTSKLAEMVPDDVILAALSGISSPADVAHYSSQGVSAVLVGESLMRASDPAAFARELLNLSSSEISNGKKTSTPLVKVCGTRSLLAAKTIVESGGDLIGLIFVEKSKRKVDLSVAKEISHFVHTTNRKHISPKKAVTGQSWFDHQYENLASSPHPLLVGVFQNQPLEYIRSIIAEVNLDIVQLHGQEPFEWIHMLDRPVIKVFPLNSSEISRPNYHIVPLIDAYVGGESGGLGKKVDWEAASFIPVSYVLAGGLTPKNVQDAISVSRPAVVDVSSGVETDGKQDLEKIKAFINAVKEL

SEQ ID NO: 17720 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 17721 - protein, 483 aa, Pseudomonas aeruginosa
MNTKLFINNVWINSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 17722 - protein, 502 aa, Xylella fastidiosa Dixon
MRLFITPHVSYPFGFLHSSRLVMSFLPSFLKRKSIDLITVHEEGRRLVPTLSWPHLIAFGIGAIVGTGIYTLIGVGAEKAGPAVLLSFVIAGVICACAALAYAEMATLMPVAGSTYTYSYVALGEGIAWIVGWSLILEYSLVVSTVAVGWSGYMTGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNERTGTPIATTLFTAILVATAAGLVPLGEIAALANAGTLTAFIAVALCLLVMRVREPQRVRAFRTPLAWVVGPIAIAGCLYLFWSLPKMTQSLFLLWNALGLCVYLVYGRHTSLLSKGVSIDTPR

SEQ ID NO: 17723 - protein, 457 aa, Chrysocapsa vernalis
YTVKETDVLCLFRVTPQPGVDPIEAAAAIAGESSTATWTVVWTDLLTACDVYRAKAYFVEEVPNTQNEFFAFIAYECDLFEEGSIANLTASIIGNVFGFKAVKCLRLEDMRIPFAYLKTFIGPAAGVIVERERLDVFGRPLLGATVKPKLGLSGKNYGRVVYEGLKGGLDFLKDDENINSQPFMRWRERFLYVMEGVNKAAAKTGSVKGSYLNVTAATMEDMYERAEFAREVGSVIIMIDLVIGYTAIQSMCIWGRKNDTIVHLHRAGHSTYTRQKNHGINFRVICKWMRMSGVDYIHAGTVVGKLEGDPNAVKGFYDTLLLPALKENRNLGIFFDMDWASLRKCMPVASGGIHCGQMHQLTHLLGEDVVLQFGGGTIGHPDGIQSIATANRVALEAMVLAKNEGRDYLKEGVEILKTASKDCRPLQTALDLWKAITFNYASTDTLDFESTPTKAAS

SEQ ID NO: 17724 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 17725 - protein, 197 aa, Methanosarcina barkeri
MPSMNRKTGAVVLIFLFAAIVFISGCVQNEKVGAPVNKEFPEDGKGDESMNIQSIKVSSSAFESNGSIPGKYTCDGQNINPPLEFEGIPEEAESLVIIVDDPDAPTKTFTHWIVWNIEPVAKIEEDSIPGIEGLNDFKKIGYGGPCPPSGTHRYFFRVYALDKNLDLKAGAGRKGLENEMIGHIIAEGELMGKYSRK

SEQ ID NO: 17726 - protein, 470 aa, Gelidium purpurascens
  unsure (1)..(470): unsure at all Xaa locations
GVIPYAKMGYWDPNYAIKETDVLALFRITPQPGVDPVEASAAVAGESSTATWTVVWTDLLTACDLYRAKAYKVEAVPNTSDQYFACISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAATGEXKGHYMNVTAATMEDMYERAEFAKQLGTVIXXXXXXXXXTAIQTMAIWARKNDMILHLHRAGNSTYSRQKNHGMNFRVICKWMRMAGVDHIHAGTVVGKLEGDPLMIXGFYNTLLMSHLDQDLTKGIXFEQDWASLRKVTPVASGGIXCGQMHQLLDYLGVDVVLQFGGGTIGHPDGXQAGATANRVALEAIVIARNEGRDYVKEGPQILRDAAKTCGPLQTALDLWKDISFNYTSTDTADFVETPTANV

SEQ ID NO: 17727 - protein, 170 aa, Thermosynechococcus elongatus BP-1
MDLKSLIRDVPDFPKPGILFRDLTTLLQNQAGLRYVIDQLVEKHANAGIDYVAGIESRGFIFGAPLAYRLGAGFIPLRKPGKLCAPVYAVEYELEYGRDRLEMHQDAIEPGRRVLIVDDLIATGGTAAAAAGLIQKAQAELYGFAFIVELTDLAGRQKLPDVPITTLVTY

SEQ ID NO: 17728 - protein, 355 aa, Xylella fastidiosa Ann-1
MCAMNVMGFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYLGPLSMPVNAGGVVRGRRAISGSFIGGAHETQQMLDFCGQHGIVSDVEIIPIQKINEAYERMLKSDVKYRFVIDMTSLTSSGA

SEQ ID NO: 17729 - protein, 478 aa, Corynebacterium efficiens YS-314
MILTLDSPEEDKRRALIHAIDGLRRQDPLVSAAVAFTRGQKIFFITGGLVFLLLAVLAPLVALIVIAGLCTLMYVVTLTDRFIMFRKGLRADAIMRVTDEEALAVPVERLKAYTILVPAYGEPEVITQLVTAMNSFDYPPHLLQVLLLLEEDDLPTIEAAERANLGEISTIIKVPPAQPRTKPKACNYGLHFATGEIVTIFDAEDIPDPLQLRRVVVAFENSPANTVCVQSRLSYRNARQNLLTGWFTIEYDVWFNFLLPGIMRMQAPVPLGGTSNHLVTEVLRELGAWDPYNVTEDADLGVRIAARGYRTAVLDSVTWEEANSDTINWLRQRSRWYKGYLQTWLVYMRRPRWLVRELGVLPALRFTFLMAGTPIVAVLNLLFWYLSLTWILGQPATIAAMFPPLVYYPALICLILGNAATMYMNLIGCREGRDPLLVVAVLTFPVYWLLMSIAALKGTWQLITRPSYWEKTAHGLEA

SEQ ID NO: 17730 - protein, 300 aa, Streptococcus pyogenes SSI-1
MMTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 17731 - protein, 534 aa, ASPERGILLUS NIDULANS FGSC A4
MADGVVAGTRVEAPVTWKTYLMCAFAAFGGIFFGYDSGYINGVMAMDYFIHEFSGKVKAEYEAADNLSGYVISSSNKSLITSILSAGTFFGAIIAGDLADWFGRRTTIISGCGIFMVGVALQTASTTVALLVVGRLIAGFGVGFVSAILILYMSEIAPRKVRGAIVSGYQFCVTVGLMLASCVDYGTENRTDSGSYRIPIGLQLLWAIILAVGLFLLPESPRYYVRKGDVSSAAKVLARVRDQDVESDYVKEELAEIVANNEYEMSLIPQGGYFATWFNCFRGSIWSPNSNLRRTILGTSLQMMQQWTGVNFVFYFGTTFFTNLGTISDPFLISMITTIVNVFSTPISFYTMEKIGRRPLLLWGALGMVICQFIVAIAGVVDGSNNKTVSAQIAFICIYIFFFASTWGPGAWVVIGEIYPLPIRSRGVALSTASNWLWNCIIAVITPYMVDEDKGNLKSKVFFIWGSLCACAFVYTYFLIPETKGLTLEQVDKMMEETTPRTSSKWKPHGTFAAEMGMTEKDVTQTVEDIAKKA

SEQ ID NO: 17732 - protein, 182 aa, Salmonella typhimurium LT2
MKTVFSLTAAAMMALSGGVSAASAFSLSSADIPADFRLTQQHVFKGFGCSGENISPQLSWRNPPAGTKSYAITVFDPDAPTGSGWWHWTMVNIPAQIHDLPTGADKKTLPAGVVQGRNDFGYAGFGGACPPPSDKPHRYQFTVWALNTATLPLDSESSGALVGFMLNAHVIAKAKFTATYGR

SEQ ID NO: 17733 - protein, 229 aa, Gossypium hirsutum
MATASTWILSLKVFLISTGILGIVLGLKISVPLVLEFSVSQAPLWWSGFRSWLKPPYLYVVINGIIITIAASSRFNQNNGEKDQMEQMQPRPKISEDQQPIVEYDTKSGWGSDAVESSDFVYEENQRGEEVATRVSEEESNVAVEDDRDGNEFVISKSEWIPPSRTDSSEIPLDALLIQEKPAPSSRFGHRKPVKVNPEGGRALKAAKPKRHETLENTWKMITEGKSMP

SEQ ID NO: 17734 - protein, 539 aa, Chlamydomonas reinhardtii
MSGDFGSEPLGSCSVETVTALLGYGLEQDSITALCQPEGGAGCTSTDNCMFQYLMGATADAQSTASDVGVGLDVSFLLFSGYLVFVMQLGFAVLCAGSIRSKNCMNILLKNMLDACVGAIGFYVFGYAFAYGRKYGQNSNGFIGNWNFALSYTTQTSMSGTEFTTFGWHQFFFQWSFCAATTTIVSGAVAERCTFMAYMIYAFFLSSFVYPVIVHWVWDGQGWLSAFNTFQDGYALILKTGAIDFAGSGVVHMTGGIAALMGAWIMGPRVGRFANDGTVNEMRGHSSTLVVMGTFLLWFGWFGFNPGSNLVVASQAAATVVSRVAVTTALAGGAGGISMLFYKFLTVKAWDVVATCNGILAGLVAVTASCSVIEPWAAIITGAIGAIIFSIADYVTLYKLKVDDPVSAFALHGAVGAWGVLFPGFLAAPHYVVEVYGAYGFGMDAREGKRFGLFYGGHGQVLLVQLIEVLAIFGWTGFMMGSFFFILNKAGLLRVPLQEEMAGLDAANYSKSVGSKDPSVHCTVGVDKLEGGALGEGKA

SEQ ID NO: 17735 - protein, 445 aa, Corynebacterium efficiens YS-314
MSRIPCSGALSRCPDRTGHAAYFSVVTELIILLIVIVTALAFDFTNGFHDTGNAMATSIATGALKPKVAVTLSAVLNLVGAFLSVEVAATVAKGIVDLDQFNLSNPGDSHQLLLVVFAGLIGAILWNLLTWLLGIPSSSSHALFGGLIGAAIASIGFGGVVWEGVLAKMILPALAAPVVAGLVAAIGTFAVYALTKTVADKDKNRYFRWGQIGSASLVSLAHGTNDAQKTMGVIFLALVATGHVGADADIPFWVKASCAFFIAFGTYLGGWRVIRTLGKGLVEIDSPQGMAAETSSAAIILTSSHFGMALSTTHVATGSIMGTGIGRTGASVRWSVASRMAVAWLITLPASALVGIVCWWIAHGIGAFSSDLLGVLVAFAILIALSVHMWLHSRKAPVDPNNVNEDWDDTTNGVAPAPKNGQKNTQKSTNIAQGHAPATTFEERS

SEQ ID NO: 17736 - protein, 273 aa, Triticum aestivum
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKQPKPQLKEEDHEDEAPDAGEDGGGAAGGGGGGGEEHGDTLCGACGDNYGQDEFWIGCDMCEKWFHGKCVKITPAKAEHIKQYKCPSCMGANGGGSGSNKRARPSS

SEQ ID NO: 17737 - protein, 409 aa, Arachis hypogaea
MALRLNPNPSQKLFLSPSSSSSSSSSSFSLPQMASLRSPRFRMASTLRTGSKEVENLKKPFTPPREVHVQGNHSMPPQKIEIFKSLEGWAEENILTLLKPVEKCWQPQDYLPEPSEDGFEEQVRELRARAKELPDDYFVVLVGDMITEEALPTYQTMLNTLDGVRDETGASLTSWAVWTRAWTAEENRHGDLLNKYLYLSGRVDLRQIEKTIQYLIGSGMDPRTENSPYLGFIYTSFQERATFISHGNTARLAKGHGDMKLAQICGMIASDEKRHETAYTKIVEKLFEIDPDGTVMAFADMMRKKIAMPAHLMYDGRDDNLFENYSAVAQRIGVYTAKDYADILEFLVARWKVADLTGLSGEGRKAQDYVCRCRPRIRRIRRLEERAQGRAKESPRLKFSWIYDREVQL

SEQ ID NO: 17738 - protein, 990 aa, Synechocystis sp. PCC 6803
MVAQIDSQQQYEQATQAIAKELLAQTREKRSLWDKIGDNLRLDDKLLDWTMGHPGLRVQLFKFIDCLPALQSNSEIANHLQQYMSEEEVELPEALKKLLNFADAHSTPAQIAAGTVSKATEQLAFKYIAGETIAQVIKTVERLRKEKMGFTIDLLGEAVITESEAAEYWQNYLDLMAQLSQQAKSWSKVPQIDQADGEILPQVQVSVKLTAFYSQFDPLDPAGSKAKVCERIRELLRRAQELGVAVHFDMEQYHYKDLILNILKELLVEEEFRSRTDVGITMQAYLRDSTEDLEALIPWAKHRGYPVTVRLVKGAYWDQETIKAQQNHWQIPVYVEKAQTDANYERMTRLLLENHEYLYAAIGSHNVRSQALACAIAEELNIPKRRYEMQILYGMGEPLARAIVKRGHRVRVYAPYGRLLPGMAYLIRRLLENTANSSFLRQNLEERPIEELIAPPQVKGINDLPTKGYGNAPDTDYADADLRQQAFQALTRVKQQLGKTYLPYINGEYVETANYIDSVNPCRPSQAIGKVGLISVEQADHALEIAKAAFPAWKKTPVRERCGILRKAADIMEERRHELNAWICLEVGKIIPQADAEVSEAIDFCRYYADEMERLDQGVNLDIPGETNRYFYQPRGIALVISPWNFPMAIAVGMTVAALVTGNCTLLKPAETSTVIAAKIAEILIAAGVPPGVFQYVPGKGSVVGSHMVNHPDVHLIAFTGSREVGCRIYADAALVQPGQKHLKRVIAEMGGKNAIIVDESADLDQAVAGAVYSAFGYTGQKCSACSRVVVLSPVHDAFVERFVEATRSLNVGPTDDPSTQVGPVIDAKAQARIQEYIEQGKAECELAIACDAPSEGYFVGPTVFKNVDRHATIAQEEIFGPVVTIIRAANFDEALEIANGTDYALTGGLYSRTPDHINRAAAEFEVGNLYINRTITGAIVSRQPFGGFKMSGVGSKAGGPDYLLQFLEPRHVTENIQRQGFAPIEGADQ

SEQ ID NO: 17739 - protein, 687 aa, Vibrio vulnificus CMCP6
MKLNAITLTLLLSSTAAIAEPNLTISTTTNSRDFPLSAEQPLVVPLVKESYQLKITGLEGDCQAPDAQVIKFNQPIALNCGKVTELPLKIRFTGDYSFELDANANTLTFKREPKKVAKTEFKRPLPQVTCEVYQGGEVTIELGDSFKDGTSLRDAYSGQVVSVKKGKVSLTPSAQSGGLVLLEPVKQNKKARPFDYRNANIYFVMVDRFNNGDTSNDQSYGRQKDGKEEIGTFHGGDLKGVIEKLDYIQRLGTDAIWLSPIVEQVHGFVGGGDSGSFPFYAYHGYWTRDFTKIDENFGRDEDLKTLVEEAHKRGIKVLLDAVINHSGYSTLADLQFDGMQVTTKEANLPEKWANWQPTSGENWHSYHSAIDYQSQNWSQWWGADWVRTGLPGYQQPGSSDITLSLAGLPDFRTESTQAVTPPQWLLENPGTRVVARDNYTVSDYLIEWQTDWVKRFGIDGYRVDTVKHVEGEVWKRLKQEATKSLDAWRKANGQSGAPFWMMGEVWGHSAYRSPYFDDGFDALINFDMQKKLDKGAACFSQMADTYRDYANTIAQQSDFNPVSYMSSHDTELFFSRFKDYAVQRNAANALLLSPGAVQIYYGDEVGRNIGPYADDFHQGTRSDMVWQLSAEQQTLLNHWQKLGQFRRAHPAIGAGVHQEIEQTGAYVFSRTLGDDKVVVAFVGHAVQ

SEQ ID NO: 17740 - protein, 320 aa, Rhodospirillum rubrum
MVGKVIMAKELALLLMLATLWGASYTFIKIGVETIPPLTLIALRTLIAGTLLAAIIGGRGLRLPNDRGTWARFLVQACLNSAIPFTLIAWAEQTTDAGLAAILNATTPVFAFLMTALITRHEAVSGRKLLGVIAGLAGIGLIVGVQALGGLGRELWAQLAIVAATLCYAAAAIFGKTFKGLDPMMPAAGSLICGAALLVPLSLVVDHPWTLAPSGRSLLALLALSVFSTALAFALYFRLIQTLGSIGTTAQAYLRVPIGVAIGVVVLGEDLSATAWLGLGCVVAGVIAMTLPGRKPAEGAAIRRGRHPSERRFRPGVDGR

SEQ ID NO: 17741 - protein, 385 aa, Solanum bulbocastanum
MANEEAEKKKNTTSSEAKQPLKTAKKKALGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNSRMAPVHVLINNAGIFSIGEPQKFSKDGYEEHMQVNHLAPAMLSILLLPSLIRGSPSRIINVNSTMHYVGFVDPEDMNVVSGKRKYTSVVGYGGSKLAQIMFSSVLQKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 17742 - protein, 297 aa, Methanopyrus kandleri AV19
MLDVVGLGALNVDELLYIPRMPERDDSVPVERRVRRGGGSAANTICWLAHLGREVGFVGKVGSDDAGDLLLREFEEYGVDTSRVVRGDGHSGTAFCLVSGDDRRILVDPGVNDELRPDEVDLDYIRKARVLHTSSFIGLRSETSLETLKRTMKAVADELMVTFSPATMVLRGWSYLEPYFEAADVVFLNETEAVHLTGDIEETLNRLAELVEVTIVTRGSDPAIVQEGTEISEVAPEPVPEEDIVDPTGAGDAFAAGFIEGILRGEPADRCCERGHAVAAECLRIEGCRPPTEGRSE

SEQ ID NO: 17743 - protein, 333 aa, Zea mays
MASSNSNSSSNPLEAMGAFFSKQVDRRKLVTTEKRALATRLSSSGDTFPGSEHRPADRKRWMAELGADKLRVHQVVWPGTHDSATNKIGVPLVTRPFAQCQSMSVYEQLAMGTRVIDVRVQEERRVCHGILATYPVDVVLDDVSRFLGETESELLILEIRTEFGHEDPPGFDRFLADKLGEHLIPQDEAVFHRTVAELLPRRVICVWKPRKSPPPRPGDPLWSAGYLKDNWIDTDLPETKFESNLKFLGQQPPVADRRFFYRVENTVTPKADNPVLCVWPVTKRIHGYARLFIAEAFAKGLGDKLQVFSTDFIDGDFVDACAGVTKARVDGTA

SEQ ID NO: 17744 - protein, 363 aa, Zea mays
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAVVVVPKAAGSKNEWVLCRVFKKSLVVGGAAAAAAPTAGKRGGTETSSNYKTGDVEAIAHLPPLMDVSGSGSGAGAAAAASAQVGCFSDALEGQFLDQTTTTPPPEAAAAATDDDGHLGALVAASSSPFQLPGFAHYYYGGGPPHLHQHHGAASLVQLLEGSVPPCNKGGERERERLSASQDTGITSDVNPEISSSSGQRFDHDHDHHLCCWGY

SEQ ID NO: 17745 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 17746 - protein, 437 aa, Desulfovibrio vulgaris subsp. vulgaris (strain Hildenborough)
MSTIVSVWAREILDSRGNPTIEVEVSLESGHSGRAAVPSGASTGTREALELRDGDKGRYKGKGVEKAVDNVMGEIAEAVIGLDALRQVQLDNTLLDLDGTDNKERLGANAMLGVSLATARAASSFLGLPLYQYLGGVNAKVLPVPLMNIINGGAHAPNNLDIQEFMIMPIGAATFRDALRMGAETFHTLKALLAADGHVTSVGDEGGFAPNLKSHDEAFKYITRAIEESGYIPGAEIALAIDAAASEFYRDGKYHLAGEGKTFSNSEMTEWLGEFTAKYPLISIEDGLAEGDWEGWGELTYKLGDTVQLVGDDIFVTNPDILAQGIDEGVANSILIKLNQIGTLTETLDTIEMAKQAAYTTVISHRSGETEDHFIADLAVGLNAGQIKTGSLCRSDRLAKYNQLLRIEEDLDDAGIYFGPMIASHFGYEGDEEFEDA

SEQ ID NO: 17747 - protein, 477 aa, Oryza sativa
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKFESLTITEILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 17748 - protein, 250 aa, Zea mays
  unsure (1)..(250): unsure at all Xaa locations
IVHTARKNQLHHESAPQEGHLPVPSFATATLLLLPLALLAAVLVAVYHNEFALQSYLARPACPSNASDTSLTGRHVAVRVAPDFRLLIGVLTLPGLYERRHLMRTVYALQQPNLTAHVDVRFVFCRLASEEQRVLVALEAMQHGDVVELDCPENMDNGKTHAYLSSVPALFGDRAYDFVMKTDDDTFLRLPQLVESLNRAPREDLYYGCMVPLRRGPRAGERVHVXXMXYVISWDLVXVDRGGRGADQEP

SEQ ID NO: 17749 - protein, 131 aa, Zea mays
  unsure (1)..(131): unsure at all Xaa locations
MSSSLPMRLLVPLTLPLIPPPPSSSDSLALRSKNPNFSLRSSSSCTSCSSSLWQLFPRRSRSXSPCVPMCTKDQDRTDILRNEDGXVTCGLESDEDSGGLRIPTQAQAIVEGAPRSQWLSPELKPFPWDVE

SEQ ID NO: 17750 - protein, 344 aa, Zea mays
  unsure (1)..(344): unsure at all Xaa locations
MRPALLKSTAELLRRSRGYASSANPERXKVAILGAAGGIGQPLXLLMKLNPLVSSLSLYDIAGTPGVAADVSHINSPALVKGFMGDDQLGEALEGSDVVIIPAGVPRKPGMTRDDLFNINAGIVKXLCTAIAKHCPNALVNMISNPVNSTVXPIAAEVFKKAGTYDEKKLFGVTTLDVVRAKTFYAGKAGVPXVTEVNVPCCWRPMAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 17751 - protein, 344 aa, Pseudomonas aeruginosa UCBPP-PA14
MTMTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEALQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 17752 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 17753 - protein, 397 aa, Amycolatopsis mediterranei
MISVDDYRDRVRALLGTAPATTLPLPAAAGLVLAEDMRAGVSLPPFDNSAMDGYAVRAADVGAAPMTLPVADDIPAGRVDVRPLEPGTTHRIMTGAPLPPGADAVMMVEDSDGGTETMTFSAAAREGAHIRHTGEDVVAGDVALHAGTMLRHSQLGLAAAVGLAEMRMHRPLRMLMASTGTELIDAPAPLRHGQIYESNSMMLAAAIRDLGCEVEVVRSVVDDVEEFRKVIEPKLAGADLLVTSGGVSAGAYEMMKDALTGQGVEFAKIAMQPGGPQGSGRWHGMPMMALPGNPVSMLMSFEAFLRPAILTALGHTDVSRRRMRARLTEKMSSPAGRRQYRRGMFTQSDREVTGVVGPRGGPGSHLLAAFTQANCLIMLPEDVTSAAIGEEMDVLLL

SEQ ID NO: 17754 - protein, 519 aa, Solanum tuberosum
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 17755 - protein, 396 aa, Triticum aestivum
MALSISAPTSSPFLPAPRQVGRWSSSPSSAKPAVFSLRRPVVVARAAAGNAPSSPAGAVVTEFDVPSGRSEIVPDTGVFDDFEKFAPTAATVSSSLLLGIAGLPDTKFKSAIDTALVDGECNTMEKPGDRMSCYLTKALGNVGAELALQVPGRVSTEIDARLAYDTQGIVQRVHELLQIYNEHDIPSERLLFKIPATWQGIEASRLLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTPSLDKMYNFSQEELVKWDHLSLAAAMGPAAEELLASGLEGYANQARRVEELFVKIWPPPNV

SEQ ID NO: 17756 - protein, 326 aa, Streptomyces avermitilis MA-4680
MTDDDVLYLSSRRVTELLDTDAAIASQRAAFTALGDGTAELPGKIMYPSRFDDSVVFAYVSRLSADTGTVAKFGSVNPGNPAAGLASVHAVINALDPVTGRLVAVMDGTAVTTLRTAAASAVAFDALATADASELGLLGSGTQALAHARAVARVRDLRSVRVWSPNPGRREQAAQRLAAELGVAAKGVDTAEEAVAQVPMVAACTLSRTPVVRGEWLAPGCTVVSVGSFEPTRSEVDAEVLRRAAAVVVDDPGTAADHAGPVVDALRERRLAPDDLIPLGAVVTGRHTARTSPGDIVFYNSVGLGIQDAAAAWAVIAAARGPREHP

SEQ ID NO: 17757 - protein, 876 aa, Saccharomycopsis fibuligera
MLMIVQLLVFALGLAVAVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYADNTTEIVKVNYNVDPSNDYFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 17758 - protein, 521 aa, Oryza sativa (japonica cultivar-group); identical to SEQ ID NO: 17147

SEQ ID NO: 17759 - protein, 308 aa, Pseudomonas putida KT2440
MSAVRKNPDAFAFQVMLGLCLIWGCQQVLIKTAAVDIAPVMQAALRNGIAAVLVGLMLCWRGGWEQVGSTWRAGLVAGGLFGVEFLFIAEGLKLTSAAHMSVFLYTAPVFTALGLHFRLPSERLRLLQWLGILLAFGGIAMAFAGGSSFEHMDGRTLLGDAFGVIAGLAWGATTVVVRCSRLSEAPATLTLFYQLAVGFAGLLLIALLSGQIGAVSLTPLAMGSVLFQGIVVSFISYLTWFWLLRKYLASNLAVFSFITPLFGVTFGVLLLDEPLSANFVVGALMVLLGVILVSAEPWVKQQLRRLVG

SEQ ID NO: 17760 - protein, 463 aa, Porphyra birdiae
MGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDLGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 17761 - protein, 70 aa, Glycine max
MDFSSVRAALDSKSYDKVADVCDNLMLQVAADGIAYQDDWPYAVHLLSHIYVHDMYLSSLFPLYICQSNE

SEQ ID NO: 17762 - protein, 1055 aa, Oryza sativa
MGLMNQMRIIKTKTESDTRIIDGRAIRFLGSARRDYSLFVNIYFIFTNMSNTGDKEKETPVNTNGGNTASNSSGGPFLGVETDNSQGSYCKYVTTSYHIICKREEKKKLLKQGKGEIQANLRRTLTAHQILSSFPNGERPRRIRLDGGTPASSPSRRNPSSASSSSVLGIPWDVDTEGLREYMGKFGPLDDCVVMKERSSGRSRGFGYVTFSSADDAKNVLECEHVLGNRTLEVKIATPKEEMKSQGSKKATRIFVARIPQSVDESMFRRHFEAYGEITDLYMPKEHGSKGHRGIGFITFQSAESVDSIMQDSHELDGTTVVVDRATPKDEEVRYPPSRGASQGGYGAYNAYISAATRYAALGAPTLYDHPGSAYGRGGYYGSSQGMGNKKIFVGRLPQEANTEDLRHYFGKFGRIVDAYIPKDPKRSGHRGFGFVTFADEGVADRVARRSHEILGHEVAIDTAAPLEGDSGGGYMEPMDLYGAYGSMRTYGRFCSGIDYDQLASSKQRSTAMSRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIMGQWACTTSVDFSLAQLLQVIILLATGGANGGGYMASKYVVLAIYSAILILHGLINSLPIRWLSWFGQLGAFWNVAAVAKERVSPEFIFTHFNAENGAGIHDKAYILAAGLLMSQYSLIGYDTSAHIVILNFLIAEQSLVSRCIHTIHPLIFSSHINIQIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 17763 - protein, 404 aa, Vibrio parahaemolyticus RIMD 2210633
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 17764 - protein, 224 aa, Glycine max
  unsure (1)..(224): unsure at all Xaa locations
GFIVAFDPLDGFSIVDTNFTVGTIFGVXPGNKLAVVTGRDHVAAAMGVMGPRTTNVLALKDFPGTHEFLLIDEDHIRSIRXRKQVVTHYPLCLFKMELVNDFPDHSKLINYYAREKYTLRYTGXMVPDVNQILFKRKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 17765 - protein, 303 aa, Candida parapsilosis
MATDSNFLIDFLMGGVSAAVAKTAAAPIERVKLLIQNQDEMLKQGRLSHKYTGIIDCFRRTAADEGIVSFWRGNTANVIRYFPTQALNFAFKDQIKALFGFKKDEGYWKWFAGNLASGGIAGALSLAFVYSLDYARTRLANDAKSAKGDGKGREFNGLIDVYKKTLASDGIAGLYRGFGPSVIGIVVYRGLYFGLYDSLKPVVLVGPLEGSFLASFLLGWVVTTGASTASYPLDTIRRRMMMTSGQAVKYDGALDCARKVVAAEGVKSLFKGCGANILRGVAGAGVISLYDQLQVLLFGKKFK

SEQ ID NO: 17766 - protein, 480 aa, Eucheuma isiforme
  unsure (1)..(480): unsure at all Xaa locations
TXXXNERYESGVIPYAKMGYWDPEYVVKDTDILALFRVSPQPGVDPIEASAAVAGESSTATWTVVWTDLLTACDLYRAKAYKVDAVPNTSDQYFAFIAYDIDLFEEGSIANLTASIIGNVFAFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 17767 - protein, 364 aa, Glycine max
  unsure (1)..(364): unsure at all Xaa locations
MARRSLPLLKHLLSRRIPARSVTYMHRPGDGSPRPVTLIPGDGIXGPMVTGAVEQVMEAMHAPXYFEKFEVHGNMKXVPPEVLDSIRKNKVCLKGGLVTPXGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 17768 - protein, 203 aa, Glycine max
MGNTEKLMNQIMELKFTSKSLQRQSRKCEKEEKSEKLKVKKAIEKGNMDGARIYAENAIRKRTEQMNYLRLASRLDAVVARLDTQAKMTTISKSMGNIVKSLESSLATGNLQKMSETMDSFEKQFVNMEVQAEFMESAMAGSTSLSTPEGEVNSLMQQVADDYGLEVSVGLPQPAAHAVPAKEADKVDEDDLSPRLAELKGRG

SEQ ID NO: 17769 - protein, 183 aa, Triticum aestivum
  unsure (1)..(183): unsure at all Xaa locations
PKHSTKFNNKQSNAVQPEEIDRARDQRARMAGMVFGLDAPMMAALQHLLDIPDGEAGAAGGEKQGPTRAYVRDARAMAATPADVKELPGAYAXVVDMPGLGSGDIKVQVEGEGVLVIGGERGREEKEDAKYRRMERRRKFVLPENADMEKISAVCRDGVLTVTVHKLPAPEPKKPKTIQVQVA

SEQ ID NO: 17770 - protein, 310 aa, Oryza sativa
MAPSRPLMRGIRPPRVFPTRGGRTSPLALALAALLLASALLLTLIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHGGCPVIKGNKWSSTKWMHVREYKA

SEQ ID NO: 17771 - protein, 365 aa, Buchnera aphidicola (Uroleucon ambrosiae)
  unsure (1)..(365): unsure at all Xaa locations
MKTKYRISVLPGDGIGPEVMREAYKILNILKNHFSLPLEIKEFNIGGAAIDQEGVALPKKTLLGCENSDAILFGSVGGKKWDHLPIDKRPERASLLPLRKHFNLFANLRPAQLYSELKYLSPLRSDIXIKNGFNILCIRELTGGIYFGKPTGRXLKKNNIEYAFDTEIYYDYEINRIAHLAFQLAQTRNYKVCSIDKSNVLNSSVLWRETVQKVSKNYPDVHLSHLYIDNATMQIIKDPNQFDILLCSNLFGDIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 17772 - protein, 241 aa, Agrobacterium tumefaciens str. C58
MPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASLDA

SEQ ID NO: 17773 - protein, 104 aa, Shigella dysenteriae
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVAL

SEQ ID NO: 17774 - protein, 333 aa, Zea mays
MALEAVVFPKEHLAGTAKARSASSLACGFRTEEVEDNGGVVLQGEAGAATTWEYWDAALCPCSTAPAGAVEECWDVRHRLSASPPPPAPSAAVAAPSSGHGKAAAAARRRRRQRPKAVKNTEEVESQRRNHIAVERNRRRQMNEYLSVLRSALPPSYPQRGDQASIVAGAINFVKELEHLLQSLEAQKRRRQGCTEPPAPAPFAGLFTFPQYSTAATGVVAGSGDGAGCGAAGARRGVADIEVAVAESHASVKVVTPRRPRQLLRMVVALQCLGLTVLHLNVTTTADQLVLYSLSLKMEDECRLSSVDDIAAAVNDILAKISDERASRHLVAA

SEQ ID NO: 17775 - protein, 1025 aa, Arabidopsis thaliana
MVWFRIGSSVAKLAIRRTLSQSRCGSYATRTRVLPCQTRCFHSTILKSKAESAAPVPRPVPLSKLTDSFLDGTSSVYLEELQRAWEADPNSVDESWDNFFRNFVGQASTSPGISGQTIQESMRLLLLVRAYQVNGHMKAKLDPLGLEKREIPEDLTPGLYGFTEADLDREFFLGVWRMSGFLSENRPVQTLRSILSRLEQAYCGTIGYEYMHIADRDKCNWLRDKIETPTPRQYNSERRMVIYDRLTWSTQFENFLATKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVIGKTRAKQYYTKDENRTKNMGILIHGDGSFAGQGVVYETLHLSALPNYCTGGTVHIVVNNQVAFTTDPREGRSSQYCTDVAKALSAPIFHVNADDIEAVVHACELAAEWRQTFHSDVVVDLVCYRRFGHNEIDEPSFTQPKMYKVIRSHPSSLQIYQEKLLQSGQVTQEDIDKIQKKVSSILNEEYEASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLIKNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKQCVSNLSEFDDVKGHPGFDKQGTRFKRLIKDQSGHSDLEEGIRRLVLCSGKVYYELDEERKKSETKDVAICRVEQLCPFPYDLIQRELKRYPNAEIVWCQEEPMNMGGYQYIALRLCTAMKALQRGNFNDIKYVGRLPSAATATGFYQLHVKEQTDLVKKALQPDPITPVIP

SEQ ID NO: 17776 - protein, 505 aa, Candida maltosa
MAIFTPELWLICFAVTVYIFDYIYTKYLMYKLGAKPITHVIDDGFFGFRLPFLITLANNQGRLIEFSVKRFLSSPHQTFMNRAFGIPIILTRDPVNIKAMLAVQFDEFSLGLRYNQFEPLLGNGIFTSDGEPWKHSRIMLRPQFIKSQVSHVNRLEPHFNLLQKNITAQTDNYFDIQTLFFRFTLDTATEFLFGQSVHSLNDGENSLQFLEAFTKSQAILATRANLHELYFLADGIKFRQYNKMVQDFSQRCVDKVLNMSNSEIDKLDRYFFLYEMVKITRNPQVLRDQCLNILLAGRDTTASLLSFAFFELALNEPIWIKLRTEVLHVFQTSLELITFDLLKTKCPYLQAILHETLRLYPSVPRNARFSKKNTTLPHGGGVDGMSPILIKKGQPVAYFICATHVDEKFYTKDALIFRPERWCEEPLIKKNLAWSYLPFNGGPRICLGQQFALTEASYVLTRLAQCYTKISLQPNSFEYPPKKQVHLTMSLLDGVHVKISNLSIS

SEQ ID NO: 17777 - protein, 148 aa, Zea mays; identical to SEQ ID NO: 10555

SEQ ID NO: 17778 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 17779 - protein, 1322 aa, ASPERGILLUS NIDULANS FGSC A4
MVSRSNEGPEAPHPASRTPGAPAKGRLTRLGSSPSKRDDKAKDDRMGKTSAKDVAELKDYIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHSTDDGLGVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 17780 - protein, 214 aa, Listeria monocytogenes EGD-e
MRFFIDTANVEEIKKANRMGFISGVTTNPSLVAKEGRDFNEVIQEITSIVDGPISGEVVSLEADEMIAEGRVIAKIHPNMVVKIPMTGEGLAAVKVLTEEGIKTNVTLVFSATQALLAARAGATYVSPFLGRLDDIGDDGLVLIRDIADIFEIHGIPTEIISASVRHPIHVIECAKAGADIATVPFKVFEQMLKHPLTDSGIDKFLADWEAAKK

SEQ ID NO: 17781 - protein, 467 aa, Streptomyces parvulus
MPTPAPDHAPAQRAAPLAVVDPATGTVFDEAPDQGPDVLDAVVDRARRAWHGWRADPDARTTALRSAADAVEAAGDDLARLLTREQGKPLAESHAEVARTAARLRYFAGLAPRTRRITDGRPVRSEVRWRPLGPVAAIVPWNFPLQLASAKFAPALAAGNTMVLKPSPFTPLATRLLGSVLATALPEDVLTVVTGREPLGARLAAHPGIRHVTFTGSVPTGRAVARAAAASLARVTLELGGNDAAVLLDDVEVDRIADRLFWAAFRNCGQVCMAVKRVYAPARLHAQVVEALTERAKAVAVGPGLDPRTRLGPVANAPQLARVEQITRRALADGARAAAGGHRLDGPGCFFAPTILTDVPPDSPVVTEEQFGPVLPVLPYRSLDEAVDAANGTGFGLGGSVWGTDLDRAEAVADRLECGTAWVNHHAELSLAQPFAGDKDSGVGVAGGPWGLYGNLRPFVVHRPRGE

SEQ ID NO: 17782 - protein, 556 aa, ASPERGILLUS NIDULANS FGSC A4
MSRLCLISLLSLAAASLGAAEGHPRFSFNKRQLPADATGVKKFKTPNGVTIRYKEPGKEGVCETTPGVNSYSGYVDLSPESHTFFYFFEARHDPANAPITLWLNGGPGSDSLIGLFEELGPCAISENLTTYVNPYSWNEVSNLLFISQPLGVGFSYAETEEGSLNPVTGVVEDSSFAGVQGRYPKINATLTDTTELAAKATWEVVQGFLGGLPQLDSTIKSKDFNLWTESYGGHYGPAFFNHFYEQNQKIRNGTIDGIELNFNSLGIINGIIDEGIQAPFYPEFAVHNTYGIKAVNETVYNYMKFANEMGNGCQDQIALCKATNRSSFADYALCSEATNMCRDNVEGPYYSYGNRGVYDIRHPYNEKDPTPPNLFVPFLQQDWVMNALGVNINYTSSNNEIYYAFQQTGDFVWPNFIEDLEEILTYPVRVSLIYGDADYICNWFGGQAVSLAVKYPHSKQFQAAGYTPLLVDGVEYGETREYGNFSFSRVYEAGHEVPYYQPAASLQLFNRTLFGWDIAEGKVQTWPGYSTNGTAWPTHTESFVPLPTATPSKGLF

SEQ ID NO: 17783 - protein, 514 aa, Thermobifida fusca
MPPGRSHAQEASQRRRQQGRGLMSISSERIAALRDYVPEVRELTIDGKPVKPAGETWDVYNPATEEVIATVSGATKEQVDEAIRAARTAFDTWSKMSGEERSAAMHSLADRLEARWEELLASIVNEVGTPVSTAEFLQVKMGLGHLRWFADAAKKDRTVHLGPYDVPVPTMSDVDHYPVGVVAAITGYNYPLNLAGFKYGAALAAGCTVVLLPSPRTPLTTLLLGEIIRESDLPDGVINVVLGGADIGQYLSSHPGVDKVSFTGSDAVGAKIMEQAAANLNDVVLELGGKSANIVLPGCDVESFAVDMHMRWSRNSGQGCAALARLLVHEDLFDRFMKAGAEAFPKMKVGDPWDPETHIGPLIRPDHRDRVNGFITEALEQGGKALLQVETPLPEKGWYVNPILLGNLPHSARAVQQEIFGPVAVVLTYKDVDEAIRLANDTAYGLAANVWAPTLEEGRRVAEQLRAGTVWINGGGAMRPDAPFGGSGRSGIGRELGEWGIQEFLEPRHIQWAL

SEQ ID NO: 17784 - protein, 334 aa, Bacillus anthracis str. A2012
MTKIGINGFGRIGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 17785 - protein, 582 aa, Synechococcus sp. PCC 7942
MAVTALSVESAAIAAAPSPPQPPRRRYRWDRRRYPRWQRSADIWRFVLLLSFRLWLIQRPWTYFGGFSSDRQNQRRRKLASWIRETCLDLGPTFIKVGQLFSTRADLFPAEYVEELSKLQDQVPAFDLEQVQQILSNELGASPEELFSDFDPVPLAAASLGQVHRARLKTGEAVVVKVQRPGLQQLFTVDLAILRGIAEYFQRHRRWGQGRDWVGIYEECCRILWQETDYLREGRNADRFRRDFRDCDWLLVPRVYWRYASPRVLTLEYLPGIKISDYTALEAANLDRQKISQLNAEAYLRQVLNHGFFHADPHPGNLAVSPTGRLIFYDFGMMGEIRTDVRSKLMQVFLGIARKDADDIVSALVELGALLPTGDLGPVRRSVQYLLDNFLDRPFEGQSISAISDDIYEIAYDQPFRFPATFTFVMRAFSTLEGVGKGLDPDFNFMTVAKPYALEIMSDATPNPAGLLNEFSRQALAVGNSALGLPRRLDDTLDKLEQGDLRVRVRASESDRLLRRLLLTQQSQTWAILTAALWIGSAIVSLSALPLLAIAPFGLGLIPLGLLIRTQLRLRRSERMGNVSNN

SEQ ID NO: 17786 - protein, 437 aa, Eremothecium gossypii
MAISKVYARSVYDSRGNPTVEVEVTTENGTFRSIVPSGASTGVHEALELRDGDKSKWLGKGVTKAVSNVNDIIAPALLSANVDVKDQKAVDALMLTLDGTPNKSKLGANAILGVSMAVAKAAAAEKKVPLYQHLADLAGSSTTPFVLPVPFLNVLNGGSHAGGALALQEFMIAPTGAESFSEALRMGSEVYHNLKSLTKKRYGASAGNVGDEGGVAPNIQTAEEALDLIVDAIKAAGYEGKIDIALDCASSEFFKDGKYDLDFKNPESDSSKWLSGQELADLYKKLVEKYPIVSIEDPFAEDDWEAWSHFYKNAGVQIVADDLTVTNPTRIATAIQKKAADALLLKVNQIGSLTESIQAAKDSFDATWGVMVSHRSGETEDTFIADLVVGLRTGQIKTGAPARSERLAKLNQLLRIEEELGSKAIYAGKKFHNANKL

SEQ ID NO: 17787 - protein, 378 aa, Glycine max
MESATVSSSESEMALPLPLASESQQPYVSELLSFTLDRLHKEPELLRVDADRIRRQMQEVAVGNYRSFIAAADALIAIRQEVSSIDNHLESLINEIPKLTSGCTEFIESAEQILEKRKMNQTMLTNHSTLLDLLEIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPRV

SEQ ID NO: 17788 - protein, 317 aa, Zea mays
MFSRKLTPTADAWATNTQNRDTSAHPRPLPTGTAQMACSHIVAAAGVSSPAAAAARSPAHSPASAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEQETFPHDALEATAWTEDGLIMAARHKKYKHIQGVQFHPESIITPEGKKIILNFVRFIEELEKQRS

SEQ ID NO: 17789 - protein, 209 aa, Zea mays
MAPTQALSSVNKVDPRLAVEQNGQNADATTNGASATTLEATQPVSPWGDVDHLLDGYDDQQKALIQKERARRITEQHKMFSARKLCLVLDLDHTLLNSAKFIEVEPIHEEMLRKKEEQDRTLPERHLYRFHHMNMWTKLRPGIWNFLQKASNLFELHLYTMGNKLYATEMAKVLDPTGTLFAGRVISRGDDGDPFDSDERVPKSKDLDG

SEQ ID NO: 17790 - protein, 251 aa, Glycine max
MDWNLKCEKTTEGEVDQANLPNMETMEGSSRYGMYRTKGEFSVDLKLGQVGNSGRESSVLTKSKDGGAVGVSKMISSSSSGSAKRARSLSNGTQTVSCLVDGCHSDLSNCRDYHRRHKVCEVHSKTAQVTIGGQKQRFCQQCSRFHSLEEFDEGKRSCRKRLDGHNRRRRKPQPESLTRSGSFLSNYQGTQLLPFSSSHEYPSTTVVNPTWGGVLTTSGDVRLHGHNQHHHQVHLADKQDLFLGSSPAGFK

SEQ ID NO: 17791 - protein, 296 aa, Ruegeria sp. PR1b
MSTGKPDTHRKGIILAGGSGTRLYPITMAVSKQLLPLYDKPMIYYPISVLMLAGIREICVITTPQDADQFQRLLGDGSQWGVSLTYVQQPSPDGLAQAFILAEEFLDGAPSALVLGDNVFFGHGLPDLLAAADARPEGGTVFGYHVADPERYGVVDFDAEGRARQIIEKPAVPPSNYAVTGLYFLDGTAPERAKQVQPSPRGELEITDLLQMYLDAGQLSVESMGRGYAWLDTGTHGSLLDAGNFVRTLHERQGLQTGCLEEIAFHAGWISRDELAERAELFKKNSYGAYLGKLLG

SEQ ID NO: 17792 - protein, 506 aa, Yersinia pseudotuberculosis
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAVEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 17793 - protein, 338 aa, Xylella fastidiosa Temecula1
MSVALSIDLSKKKTILCFGEALIDMLAQPLVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRVEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGEVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 17794 - protein, 212 aa, Zea mays
MQRDGHEGDVSCQGRDDTVMFGPDDDGVKIPTQVETLVKGTAMVAEPEYKASPDLDYLQELLAIQQQGPRAIGFFGTRNMGFMHQQLIEILSYAMVITKNHIFTSGASGTNAAVIRGALRAEKPELLTVILPQSLKKQPPESQELLSKVQNLLEKPQYDHLPLIEASRLCNMDIISKVQQVICFAFHDSKLLMETCQEAMNLRKIVTLFYLD

SEQ ID NO: 17795 - protein, 386 aa, Lactobacillus gasseri
MHFLGELILILLATTLLGQLFSRLNMPAVIGQLLSGILLGPAILGLVKPNEIISLFSEFGVILLMFLAGLESDLDLLKKYFNLSFTVAGIGVILPVFFMGIASYLFGMNFLEALFIGIVFAATSVSISVVVLQEANQIHTRTGTAILGAAVVDDILAVIVLSLFTTFSHEGGKSGLTNNFFLNLLIEVIYFVVVWIIFKFIAPYFMKLAEKIEVDYAVVIGSLVLALSMAWAADFVGLSAVVGAFFGGLAIRQTPQYKEVQSSVSAIGYSIFIPVFFVNIGLSMTFASFIKDIWFIIVMTILAVVSKFWAGKYSSELFGFTKNEGNIVGAGMVSRGEVALIVAQIGITHHLFPEDIYSSLILVIIITTVLSPFILNYYIKRGVKNN

SEQ ID NO: 17796 - protein, 246 aa, Saccharomyces cerevisiae
  unsure (1)..(246): unsure at all Xaa locations
RTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 17797 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFTRIIGFDNVRQVQCISFIAYKPASYDA

SEQ ID NO: 17798 - protein, 220 aa, Rhodospirillum rubrum
MALNVEPSADPDNPPFDNGPRNSVDIQGFGPPPGRLGSAAVPSPHPESSMNLKDHIREVPDFPKPGILFYDISTLLADPDAWQVTMGRMAKVVAPRLPDVLAGIESRGFLVAAPLALKLGLGFVMVRKKGKLPGATVRHEYALEYGTDTVEVQEGAVLPGQRVVILDDLLATGGTLNAASELLGKMGANVVGAACIIELSFLKGRERTKVPIDSLVAYDS

SEQ ID NO: 17799 - protein, 191 aa, Halobacterium sp. NRC-1
MTRILVVDNYDSFVYNLVQYVGAAADDVVVRRNDAIDTAAVRDLDPDGIVVSPGPGTPADAGVTVPVFRELSYPTLGVCLGHQALCAAAGATVTAAPRVVHGKPSTVRHDGTGVFAGLPDTFDTGRYHSLSVPESGLPDAVVPTARTTDGVLMGVRHRDAPHVGVQFHPESILTPVGSELITNFLSLCDTT

SEQ ID NO: 17800 - protein, 295 aa, Staphylococcus aureus subsp. aureus Mu50
MSKIIGSDRVKRGMAEMQKGGVIMDVVNAEQARIAEEAGAVAVMALERVPSDIRAAGGVARMANPKIVEEVMNAVSIPVMAKARIGHITEARVLEAMGVDYIDESEVLTPADEEYHLRKDQFTVPFVCGCRNLGEAARRIGEGAAMLRTKGEPGTGNIVEAVRHMRQVNSEVSRLTVMNDDEIMTFAKDIGAPYEILKQIKDNGRLPVVNFAAGGVATPQDAALMMELGADGVFVGSGIFKSEDPEKFAKAIVQATTHYQDYELIGRLASELGTAMKGLDINQLSLEERMQERGW

SEQ ID NO: 17801 - protein, 364 aa, Zea mays
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPAATTDATAPSDA

SEQ ID NO: 17802 - protein, 815 aa, Escherichia coli CFT073
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNDLQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYERQEEWTAKAMLNIANMGYFSSDRTIKEYADHIWHIDPVRL

SEQ ID NO: 17803 - protein, 212 aa, Glycine max
MADQGLEGSQPVDLQKHPSGIVPTLHILSGIVPTLQNIVSTVNLDCKLELKTIAFPARNAKFNPKLTRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFLSGKIVLTGAKVRDETYTAFENIYPVLTEFRKNQQ

SEQ ID NO: 17804 - protein, 763 aa, Arabidopsis thaliana
MWRLKVGEGKGKDPYLFSSNNFVGRQTWEFDPKAGTREERTAVEEARRSFFDNRSRVKPSSDLLWKMQFLKEAKFEQVIPPVKIDGGEAITYEKATNALRRGVAFLSALQASDGHWPGEFTGPLCMLPPLVFCLYITGHLEEVFDAEHRKEMLRYIYCHQNEDGGWGFHIESKSIMFTTTLNYICLRILGVGPDGGLENACKRARQWILSHGGVIYIPCWGKVWLSVLGIYDWSGVNPMPPEIWLLPYFLPIHLGKAFSYTRITYMPISYLYGKKFVGQITPLIMQLREELHLQPYEEINWNKARHLCAKEDKYYPHPLVQDLIWDALHTFVEPLLASWPINKLVRKKALQVAMKHIHYEDENSHYITIGCIEKNLCMLACWIDNPDGNHFKKHLSRIPDMMWVAEDGMKMQCFGSQLWMTGFAVQALLASDPRDETYDVLRRAHDYIKKSQVRDNPSGDFKSMYRHISKGGWTLSDRDHGWQVSDCTAEAAKCCMLLSTMPTDITGEKINLEQLYDSVNLMLSLQSENGGFTAWEPVRAYKWMELMNPTDLFANAMTEREYTECTSAVLQALVIFNQLYPDHRTKEITKSIEKAVQFIESKQLRDGSWYGSWGICFTYGTWFALCGLAAIGKTYNNCLSMRDGVHFLLNIQNEDGGWGESYMSCPEQRYIPLEGNRSNVVQTAWAMMALIHAGQAKRDLIPLHSAAKFIITSQLENGDFPQQELLGASMSTCMLHYSTYKDIFPPWALAEYRKAAFIHHADL

SEQ ID NO: 17805 - protein, 216 aa, Azotobacter vinelandii
MCVIPKKKRAGTGIGAGKEDGGAGRGREPGAANAAIPRRRADSGLAALAMDDADDKLAVNHTSRPDSVERYRSGFFPVERGTRMDKLEKSLDVWRELLSDERFRICRLGGTERAFSGEYYATSVPGVYHCACCDAPLFDSDAKYDAGCGWPSYFQPVAASALTSRDDYSHGMHRIEVLCARCDAHLGHVFPDGPPPTGLRYCINSASLRLKPRDEG

SEQ ID NO: 17806 - protein, 795 aa, Zea mays
MDANHSPPAQPERHHGSFNYDIESTDGTWRGAGAWQEQDPSSEALLRYDDDGPREPLLRRRTMNTTSQIAIVGANICPIESLDYEIVENDLFKQDWRSRKKQQIFQYIVLKWSLVLLIGLCTGLVGFFNNLAVENIAGFKLLLTSDLMLKHRYFTAFLAYGGCNLVLAAAAAAICAYIAPAAAGSGIPEVKAYLNGVDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIQFCRSGKCGLFGQGGLIMFDLSSTVPSYSTQDIIAIIVLGIIGGVFGGLFNFLLDRILRAYSFINERGAPYKILLTVTISIITSACSYGLPWLAPCTPCPADAVEECPTIGRSGNFKNFQCPPGYYNGLASLFFNTNDDAIRNLFSSGTENEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPYMTHLVASDVVSGPLISFSGVERVGNIVQALRITGHNGFPVVDEPPLSEAPELVGLVLRSHLLVLLKGKGFMKEKMKTSGSFVLERFGAFDFAKPGSGKGLKIEDLDFTDEEMDLYVDLHPITNTSPYTVVETMSLAKAAVLFRALGLRHMLVVPKTPGRPPIVGILTRHDFIPEHIHGLFPNIHKSH

SEQ ID NO: 17807 - protein, 475 aa, Eremothecium gossypii
MGNTPSSSTETKDLEEKPQKSVGAGREKEIPMPEQLKDVSMVDVSEAAAEPVAEDSRRKVKRVHPGEVAQTFSQLSLRGGEDMGLAEKRSTTLIFDYDDDMASKGLNHAGVGSNSDIDSMADDRMATEQPAGSSSSSCISPPPQHDVLGPPAYGMYGATQPQGAAREAQAQPPQPPSQQQQQQQQQQQASPPMVPVEITWQQGGSRVYVTGSFTGWRKMIGLVADPARPGVFQIKLQLPPGTHRFRFIVDNELRFSDFLLTATDQMGNFVNYLEIVSPQPAGQQHIQAPHAPRLQAPFDQAQSTHTNPSDLRPDDARIDGDAYSRTEKQMSARSKLALQIEEEPDDMGDGYTRFHEEIKTKPAYEFTQDIPAVFTDPSVMGQYYLTLDQQQHNQQNLAWLTPPQLPPHLEHVILNHYNKSADGVSENTSGALPIPNHVVLNHLATSSIKHNTLCVASIVRYKQKYATQILYAPLQ

SEQ ID NO: 17808 - protein, 357 aa, Desulfovibrio vulgaris subsp. vulgaris (strain Hildenborough)
MHMNICLLPGDGIGPEIVAQGTKVLDAVARRFGHTVSTSSALIGGAAIDATGSPLPDATVEACRTSDAVLLGAVGGPKWDDLPSEKRPEKGLLGIRKALGLFANLRPAALFPELAGACLLRADIAAAGLDLVVVRELTGDVYFGQPAGIETRDGLRTGFNTMIYDEDEVRRIARVAFDTARARKRRVCSVDKANVLATSRLWREVVEEVARDYPDVELSHMYVDNAAMQLVRWPAQFDVIVTGNLFGDILSDEAAVITGSIGMLPSASMGSGGPALFEPIHGSAPDIAGQDKANPIATILSVGMMLRLGFGLAAEADAIDAAVRRVLAEGYRTGDIMENGRTLVGTVSMGNLIAERI

SEQ ID NO: 17809 - protein, 182 aa, Triticum aestivum
CTSSSSFKMWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKGNLKFPRKNYFLLWMVESMNGDRAKFHSSGHEERQSVCPSSGGTSSSQHHRRTPRMRRRPRRQR

SEQ ID NO: 17810 - protein, 472 aa, Neisseria meningitidis Z2491
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDTLVPTVCASLEEALAALKADHEFLLRGGVFSKDWIDSYIAFKEEDVRRIRMAPHPLEFEMYYSL

SEQ ID NO: 17811 - protein, 335 aa, Brucella suis 1330
MAVRVAINGFGRIGRNILRAIVESGRTDIQVVAINDLGPVETNAHLLRYDSVHGRFPKEVKVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 17812 - protein, 506 aa, Methanosarcina barkeri
MKASSVELNPNKLVQYLNKPASEFTKDDIIKFIKENGIKMLTFRYIGGDGRLKALAFVIRDEEHLDNLLSAGERVDGSSLFTYIEADSSDLYVLPKYKTAFVNPFEEIPTLDILCSYFDKDGNPLASSSETVMKKAAQVLTEKTGYELQSMGELEYYIIANKEDVNMAFPAVDQQGYHESNPFTKFDQLRKEAMMYISEAGGKIKYGHSEVGNFTDDKYYYEQNEIEFETDSLENTVDRLLIAKWMLRMLADQYGVIVSFAPKITVGKAGSGLHVHMKLLKDGKSVMVENGGVSDTAKTAIAGILDIAAGITAFGNRIPTSYLRLVPHQEAPTNICWGDRNRSALIRVPLGWFSEESSKMVALANPNYSEEFKSHSYKSTFEFRAADPSADLYLLMAAFAVGIRHGFEMDNALDVAKKLYIDVNIFKDEHKDRLAQLEHLPASCYESAQALEKLKNIFMEYDVFTEGMIDDNVKYLEGLDDYQLSERLYGKDEEIRKLVDSYIHIG

SEQ ID NO: 17813 - protein, 339 aa, Haemophilus somnus 129PT
MNKNIDWENLGFSYIKTDYRYISYWKNGAWSKGELTQDNVLHISEGSTALHYGQQCFEGLKAYRCKDGSINLFRPEQNALRMQKSCQRLLMPEIPVEMFVDACKQVVKANADWLGPYGSGATLYLRPFLIGVGDNIGVSPAPEYIFSIFCCPVGAYFKGGMKPTNFIVSDYDRAAPQGTGAAKVGGNYAASLYPGKMAKTRHFADCIYLDPTTHKKIEEVGSANFFGITKDNKFITPLSPSILPSITKYSLLYLAKERLGMEVIEGDVYIDQLDQFKEAGACGTAAVITPIGGIQYGDHFHVFYSETDVGEITTKLYNELVGIQFGDVDAPEGWIVKVE

SEQ ID NO: 17814 - protein, 441 aa, Mazzaella heterocarpa
MGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGVDVVLQFGGGTIGHPDGIQAGATANRVALESMVIARNEGRDFVAEGPQILQDAAKTCGPLQTALDLWK

SEQ ID NO: 17815 - protein, 176 aa, Cucurbita pepo
RVGLSGKGIPVGKLSLYTALGGVRPSACLPITIDVGTNNEKLLNDEFYIGLKQRRATGEEYYELLHEFMTAVKQNYGEKVLIQFEDFANHNAFELLAKYRTTHLVFNDDIQGTASVVLAGAVSALKLIGGTLADHTFLFLGAGEAGTGIAELIALEISKQTNAQLRRPARRFGWWT

SEQ ID NO: 17816 - protein, 365 aa, Neisseria meningitidis Z2491
MKSVRSFIRDDIQAMSAYQIADVPPGFAKLDSMESPVHPFAGHETLLQEWQARLAAAPIHLYPNPSGSGLQEALRSAFDIPDCADIALGNGSDELIQFITMLTAKPGAAMLAAEPSFVMYRHNAALYGMDYVGVPLNGDFTLNLPAVLEAVRKHRPALTFIAYPNNPTGVCFTRAEIEAVIEASDGIVVVDEAYGAFNGDSFLPQAGSIPNLIVMRTVSKIGFAGLRIGYAAGCPEVIGELQKILPPYNMNQLSLTTAKLALQHYGIISANIDSLKNERERMFAELGKICRLNTFPSQANFITIRVPDADLLFDTLKQNRILVKKLHGAHPLLEHCLRITVGSPAQNDAVLNIIRQLYCQPTDFL

SEQ ID NO: 17817 - protein, 416 aa, Staphylococcus epidermidis ATCC 12228
MNMNDTIFLFLCTLLVWLMTPGLSLFYGGLVQSKNALNTVMQSMVAIVIVTFIWIMIGFSLSFDGGNQWIGGLKFLGLHHVGFETSKTLSPHIPLSLFMLFQMMFCTIAVSILSGSIAEKMRFIPYLIFVSLWVLLIYSPVAHWVWGGGWISKIGAIDYAGGTVVHITSGVSGLVLGIMIGIGKKKEKHTPHNLLITLIGGILVWLGWYGFNVGSAFTFDHIAMISFVNTVIGASAGAFGWLIFEYILKKTTSLLGLLSGALSGLVAITPAAGYVSYMSAMIIAIMGGIGCYIVINLIKVKLQYNDALDAFGIHGVGGILGAVFTGVFQSHQINSAVENGFIYTGDFKIVVIQLGAAIATVVFSAIVTFLIARFIKIFTPLATTQEEDKTGLDVIVHGEKAYFYGELNKFNRHIKF

SEQ ID NO: 17818 - protein, 83 aa, Viscum album subsp. album
LGFAWSWGPLGWTVPSEIFPLEIRSVGQSVTVAVNLLFTFAVAQSFLSLLCVLKWGIFLFFAAWIAAMTVFVYVFLPETKGIP

SEQ ID NO: 17819 - protein, 146 aa, Triticum aestivum
  unsure (1)..(146): unsure at all Xaa locations
MAAAKSNQLSTLVPNMFAAGLLDDQFRQLEMLQDEGNPDFVAKVVMLFCEEGERIIGELAKQLDQPCVDYGKVDTFVDQLWGSSLYVGAQRVKNTCIQFHECCQEKSKVGCLKTLDFLRNDFYDPCSMFXHRLQLQQHVLTCRPEQ

SEQ ID NO: 17820 - protein, 283 aa, Glycine max
MVEHADLKDGGGDAVSWQIGRCKTEILQHPLYEQLLSAHVACLRIATPVDQLPRIDAQLAQSQNVVAKYAVFGHNNIVADDKELDQFMSHYVLLLCSFKEQLQQHVRVHAMEAVMACWELEQSLQSLTGVSPGEGTGATMSDDENDQVDSDANLFDCSFDGADSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTALKSKRKR

SEQ ID NO: 17821 - protein, 389 aa, Escherichia fergusonii
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTDKKIVIKNVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 17822 - protein, 436 aa, Ceratopteris richardii
MEDKSYVESKLGAPTWLSGAVQQQQVRASQQGTTNSAGSSFVNEATQQQQSHDTPRKWCGCEAGGQCVQCSFMHLSGGGAGGGGSSVAGNGIAMTANHNQQHSAAEAAGLLAIARSGGDLAQSGQGGRGNLLDLHSDTANSSDLVEGEHGGGEHGGGGHNQQDSQVLWQNARLKADITMHPLYDQLLAAHVACLRIATPVDQLPRIDAQIAQASQIVAKYAVLGQNNLLVGEEKDELDQFMAHYVLLLCTFKEQLQQHVKVHAMEAVMACWELEQSLLTLTGVSPGEGTGATMSDDDDDPAESDPSIYDPAFDTHDSGAFGPLIPTETERTLMERVRQELKNELKNGYKDRIVDVREEILRKRRAGKLPGDTTSVLKAWWHAHSKWPYPTEDEKARLVQETGLQLKQINNWFINQRKRNWHSNPSSTAAMKTKRKR

SEQ ID NO: 17823 - protein, 165 aa, Desulfovibrio vulgaris
MSTIVSVWAREILDSRGNPTVEVEVSLESGHTGGAAVPSGASTGSREALEMRDGDKGRYKGKGVEKAVDNVMGEIAEAIVGLNSLRQVQVDNTLLDLDGTDNKSRLGANAMLAVSLAHRAAASSFLGLPLYQYLGGVNAKVLPVPLMNIINGGAHAPNNLDIQEF

SEQ ID NO: 17824 - protein, 661 aa, Bacillus anthracis str. Ames
MEQLKHHVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDAVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINKEGKAHFVKFHWKPALGVHSLVWDEAQKIAGKNPDFHRQDLYEAIEKGDYPEWELGLQLIPEEDEHTFDFDILDPTKLWPEEEVPVKLVGKMTLNKNVDNFFAETEQVAFHPGHVVPGIDFSNDPLLQGRLFSYTDTQLSRLGGPNFHQTPINQPVCPFHNNQRDGMHQMQIHRGQTSYHPNGLNDNQPATVQAEQGGYEHYQEKIDGHKIRGRSKSFLNFYSQAKLFYNSMSPIEKQHIKEAFCFEVGKCKSDMVKANVIALLNHVDRQLAQEVANIIGAPLPKENHEVNSDAKSPALSMSNTIFKADSKNVAIVLNGDPSVSLLSEWIQAFAQHRINYSIVDNKIYQFNNSIKVTDTYTTTDSSLFDAVLVFSSESAIHPPVLEFAETTFKHFKPIAHVLSNPHALDNSKIKLDGAGIYNLANTSIESFIEGIAQGRFWNR

SEQ ID NO: 17825 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAYALSQGLKVIACVGETLEQREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAATV

SEQ ID NO: 17826 - protein, 313 aa, Avena sativa
VVVITGASSGLGLAAAKALAETGKWHVVMACRDFLKASKAAKAAGMADGSYTVMHLDLASLDSVRQFVDAFRRAEMPLDVLVCNAAIYRPTARKPTFTAEGVEMSVGVNHLGHFLLARLLLEDLQKSDYPSRRLVIVGSITGNDNTLAGNVPPKANLGDLRGLAGGLTGASGSAMIDGDESFDGAKAYKDSKVCNMLTMQEFHRRYHEDTGITFSSLYPGCIATTGLFREHIPLFRTLFPPFQKFVTKGFVSEAESGKRLAQVVGEPSLTKSGVYWSWNKDSASFENQLSQEASDPEKARKVWELSEKLVGLA

SEQ ID NO: 17827 - protein, 407 aa, Oryza sativa (japonica cultivar-group)
MEAPPGPEPMELDAPPPPAAVAAAAATAGISEKVLQKKEEGGGDAVTGHIISTTIGGKNGEPKRTISYMAERVVGTGSFGIVFQAKCLETGETVAIKKVLQDRRYKNRELQLMRAMEHPNVICLKHCFFSTTSRDELFLNLVMEYVPETLYRVLKHYSNANQRMPLIYVKLYIYQLFRGLAYIHTVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFKFPQIKAHPWHKIFHKRMPPEAIDLASRLLQYSPSLRCTALDACAHSFFDELREPNARLPNGRPFPPLFNFKHELASASPELIHRLIPDHIRRQHGLNFAHAGS

SEQ ID NO: 17828 - protein, 478 aa, Gigartina skottsbergii
ITNQRYESGVIPYAKMGYWDPDYVIKDTDILALFRVSPQPGVDPIEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERFLYSMEGVNRAIAAAGETKGHYLNVTAATMEEIYERAEFAKQLGSIIVMIDLVIGYTAIQTMAIWARKNDMILHLHRAGNSTYSRQKIHGMNFRVICKWMRMAGVDHIHAGTVVGKLEGDPLMIRGFYNTLLLPYLEVNLSQGIFFEQDWASLRKVTPVASGGIHCGQMHQLLDYLGDDVVLQFGGGTIGHPDGIQAGATANRVALESIVIARNEGRDYVTEGPQILQDAAKTCGPLKTALDLWKDISFNYTSTDTADFVETPTANV

SEQ ID NO: 17829 - protein, 278 aa, Borrelia burgdorferi B31
MKGIILAAGYGTRFLPITKTIPKEMLPILNKPAIDYIIQEFIDSGIKDILLISSRRKKVLEDYFDREIELENIFLKENKKDELEKIRSKKINISFIRQKEMLGTGNALLYAKPWINREPVVVAYPDDLCIGNPPLSLQLIKLYEKTGKNIISIIENPENINRYGVIDLYKDEIHVKNIIEKPKIGSEPSNKASIGRFLYNYEFFEHLEEGFKLHKKGEYYHIYALKKLMDQKKVLYKNIEGKRIDIGTLEGYLEAIINSAKKDKKLMGIIKKGINEND

SEQ ID NO: 17830 - protein, 374 aa, Leptospira interrogans serovar lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 17831 - protein, 264 aa, Triticum aestivum
MEAAVGGSWTRVRTLGRGASGAVVSLAADDLSGALFAVKSAPAAAADQLRREGDILSGLSSPHVLPCLGFRAAAGECQLFLEFAPGGSVADVAARSGGRLEECAVRAYAADVARGLAYLHGRSLVHGDVKARNVVVGADGRAKIADFGCARAVGSSDRPVGGTPAFMAPEVARGEEQGPAADVWALGCTVVEMATGRAPWSDMDDVLTAMHRIGYTDAVPEVPAWLSAEAKRFLAMCFARDARDRCTAAQLLEHPFLASAGCGV

SEQ ID NO: 17832 - protein, 214 aa, ASPERGILLUS NIDULANS FGSC A4
MSQHTASTSPDASSTTQVAGHPSSATSRAAELASLKVKLRGALRQFPDFPSPGILFEDILPIFSDHSTHEALVRCLELHILETLADEKPDVIVGLEARGFLMGPSLALKLGAGFVPVRKRGKLPGPCETQGYEKEYGQDFFQMQSDAIKPGQKVIVIDDIIATGGSAYAAGELIKKMGGNVLGFVFLLELEFLHGRDKLSAPVHTLLTGQETKA

SEQ ID NO: 17833 - protein, 309 aa, Glycine max
  unsure (1)..(309): unsure at all Xaa locations
MATIKAVKARQIFDSRGNPTVEVDVILSDGSFHRAAVPSGALLXVYEALELRDGGSDYLGKGVLKAVENVNSIIAPALLGKDPTKQTEIDNFMVQQLDGTVNEWGWCKQKLGANAILAVSLAVCKAXCSVRKLSGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKVCYINFKSEICNAILAVSVSLAVCNAGAAVKKIPLYKHIAWLETRLWYYLCFHSMLSMEAHMQEIS

SEQ ID NO: 17834 - protein, 1165 aa, GIBBERELLA ZEAE PH-1
MDLRNILDATDFYSNFTAALSTFSLDHLDSPTLNLQIIIQEGNSADGDRSGSLETNEEPILQSGHLLLSHKIPLRIGNGSCSIEPASPSLVSREPSPELRIPTNQRQVEIQRRTQSHKSHKRQGGLRLAAVNGDVPVEGDVDNANPRQMQVGQENFPKRVKVKHDGVFHPKESSLGKFVAGVWEQIHSGVILEPHVLTEQVQLTSRSSGNSPSGDLVSTAPSIRPDQTWESFNRSNIFCQRVTQASRTCRSIEVIVQARWVELFDSYVEYLASTNPNLSMTKCRMRAIAEACTDFGWTEKELRNKMGIWRGYKEIKDVLGWVALVFSGMGLYRLCKYRVDFDKDKFSRARTLGKRMEVAADTLHTNWRQLLAIVGESTEPRFAGHPHDWVVQQDGSDPVPLRSTYLAYDSNFTFEHLEESIIDTALWGADDPRWTPPSSAICLSGINVCDLCSEVQSNESAVNACKCFPNLFGVPRLPIAVQVFCTSNGRNNGLQALVAFERGTAIGEFVGLITKDIEEQDVMDSQAGGTRYQIWQGKQGNFTRFANHSCKPNAQFEKFVWLGTQHIVMNNTADIPLLFRFNMINRKIPLASYLFTRLKQAGTRRIYGVPGDFTLRALDHVPRSGIQFVGCCNELNAGYAADGYARAQRHRLQSGLGALITTYGVGELSAANAVAGSYAEHLPVVHIVGTPSQKARQVSTTSVGGRSPHLHIHHTLADSRIGVFREIAEKFTVAQLDLSGVDAEDVPTKVDEVLAKALYHSRPVYVELPSDAVETVVSSTLLERPIEERHTINDESSHLETREMADSLLQRLYAAKRPLILVDRGDGIETIRPDINEFVQKSGIPTLSLPSGASMVNNSLPNYFGVYSGSIGIVDLTSAVKSADLVLAFGCQFSDTQTLGWGVVPERNSMIMIGRNNIEDHQTGTGEILRMVTANLDKRSLAEQDTSSWGNFRHLPSQTVEPASPINQDEFYIHLNKYLKDDDNILLGNATPIIGGRDFVLPPSSQLIASGMWFSIGHMLPAAMGVSQAKADQGSSGRTILLDGDGSFQMTAQELSTIIHKRVNMVVFIINNSGYTYERYIHGMDEEYNDVAPWNYSLGPNLFGQAPDGYPIQSCRVHTWKELDSVLNSEGFSTGKGLTLVDIVIDKYDISERAKALFELVNKQL

SEQ ID NO: 17835 - protein, 331 aa, Oryza sativa (indica cultivar-group)
MEANLPPGFRFHPRDEELIVDYLYHKLSGGDGGGGAGEFYGGVAMVDVDLNKCEPWELPAYFLHNLIIFPARARARAAGRRRRADAARVGATEWYFFSLHDRKYATGQRTNRATRSGYWKATGKDRAIVTRRRAAGGEAVAGGEVVGMRKTLVFYQGRAPRGSKTEWVMHEFRVDGHAVADHPSSSTSSSSSNLLKEDWVLCRVFYKSRTANPRPVVSGEAAVSLSGELSLPPPPPLPVAPAVIDGYTGGGYYEQDSSAGCHHHHHRPPTSAALPFKDLTDFRDLLSNMVQGGGAAAAAAKSEGFHLGWSEEESSGYVQQSAMASQAWNPF

SEQ ID NO: 17836 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPXVSQLRQIVRLISESKRPVLYVGGGSLNSSEELGRFVELTGIPVASTLMGLGSYPCNDELSLQMLGMHGTVYANYSVEHSDLLLAFGVRFDDRVTGKLEAFASRAKIVHIDIDSAEIGKNKTPHVSVCGDVKLALQGMNKILENRGEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEXXGRTKY

SEQ ID NO: 17837 - protein, 422 aa, Staphylococcus aureus subsp. aureus Mu50
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVENEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 17838 - protein, 361 aa, Zea mays
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAVVVVPKAAGSKNEWVLCRVFKKSLVVGGAAAAAAPTAGKRGGTETSSNYKTGDVEAIAHLPPLMDVSGSGAGAAAAASRPAGCFSDALEGQFLDQTTTTPPPEAAAAATDDDGHLGALVAASSSPFQLPGFAHYYYGGGPPHLHQHHGAASLVQLLEGSVPPCNKGGERERERLSASQDTGITSDVNPEISSSSGQRFDHDHDHHLCCWGY

SEQ ID NO: 17839 - protein, 337 aa, Antirrhinum majus
MAPIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 17840 - protein, 410 aa, Bacillus cereus ATCC 14579
MNMGDTVFMFVTTVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLREFGALDFAGGNVVHITSGVAGLVLAIFLGKRKNINGSSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTAVNGDGANGLFYGNASLLLKQLVAIGATYAFTIIMTYAIIKAINFFLPVRVDEHEEHMGLDISMHGEKAYEYTERVN

SEQ ID NO: 17841 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKHEEW

SEQ ID NO: 17842 - protein, 178 aa, Glycine max
  unsure (1)..(178): unsure at all Xaa locations
MASFLQELLIGFPFTSAAYVGEKSKRYLPDPATQYNTSTTSSEQGRVNSVLTGMNRLGRKTNNLATGLKEHVKLGPKITDTVKGKLSLGARILQVGGVEKVFMQLFSVKDGGEKLLKACQCYISTTSGPLAGLLFISTDXVAFCSDRSIKAYSSKGHLIRIHYKVVIPLEKIRSINQS

SEQ ID NO: 17843 - protein, 977 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIASLSSHLRRALVWVLSFLAHGYATEEFEVTEERLGVYRPEEHIDNPLGYADGKDAREFDPRLRGPVHPGELEIDLYSGMKNYIANERLAYQQGWNTTSAGYIRFSLERCIHFGRLYTSGSRGRGKESDLCEALRCLGQALHTLEDFPAHSNYCELVLIDMEERRGGHSPVFPHVGTDTRITLRNDTRNNGKSVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLAPFLRPIINQVTQVLKEGSSGLIATSAKQQLEPWNNPQCDNPTHSMLSKDHFTNILNSCAGRVAANIVQYVVPRVVYAWENPGVPDSEVIADVLQVFHHPANYKEEVEIQRTMYETVVQWSRETHHDYKTLLASESVKEGHNHVLNGQPMDRGPGGGHTSCGADGGHGKVAGSLWSKIQSRDLDTSAPSGGVGGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSSQPSYGAPPSQPPYGSQPHYGGPPHSSYSGGRPPSPPRPSGYGGGYAGYSAGPPPSHGGYGGSPHGGAPYPHGGAVGGGGSAPYPHGGRADAYERNYDQHYERDERRGGRDGRRRRGSHGSRSSSEERDGRGYPGQGSRGSGHHGGGGGYGGGYGGGYGGGYGGGYGGGGGYGGSYGGRDEHRRY

SEQ ID NO: 17844 - protein, 475 aa, Solanum tuberosum
TTNSGAPVWNNNSSLTVGARGPVLLEDYHLVEKLANFDRERIAERVVHARGASAKGFFEVTHDIAHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDIGIPQDYRHMDGSGVHTFTLINRAGKSTYVKFHWKPTCGVKSLLEEEAIRVGGANHSHATQDLYDSIAAGNYPEWKLFIQIMDPDHEDKFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDQVRHAEVYPIPSTVCSGKREKCIIQKENNFKQPGERYRTFTPDRQERFIRPWVEALSDPRITYEIRSIWISYWSQADKFLGQKLAFRLNVRPSI

SEQ ID NO: 17845 - protein, 480 aa, Euptilota formosissima
  unsure (1)..(480): unsure at all Xaa locations
GRIKNERYESGVIPYAKMGYWDPNYVVKETDILSLFRVSPQPGVDPVEASAAVAGESSTATWTVVWTDLLTACDLYRAKAYKVTEVPNTTDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLRGGXXFLKDDENINSQPFMRWKERFLYSMEAVNRSIAATGEVKGHYMNVTAATIEEMYERAEFAKQLGTVIIMIDLVIGYTAIQTMAIWARRNDMILHLHRAGNSTYSRQKIHGMNFRVICKWMRMAGVDHIHAGTVVGKLEGDPAMIKGFYDTLLKSHLKLELPLGIFFEQDWASLRKVTPVASGGIHCGQMHQLLDYLGDDVVLQFGGGTIGHPDGIQAGATANRVALESVVIARNEGRDYVAEGPQILVEAAKTCGPLQTALDLWKDITFNYTSTDTADFVETPTANV

SEQ ID NO: 17846 - protein, 515 aa, Neurospora crassa
MPNLRTRNPRSLANENDENSTATTTRMTRAKAATLHVDELSMPAKTMQTKKTTISTTTAATAARTVGKRNALGDVSNVTKVEVAGTKKAIAKPGLVSKAAQPSGIQKKTTTATSRTATTARRALSNKEPNKTVGPSAGAGTIPAKRKPPPSTSKLAPIKESAPVENEPARKKIHVEEPEKKKVSRTEAKENDAPSKAVKPMAEPPAPVVRDVVPVQSVYPPGVKDLDTEDLEDPLMVAEYATEIFEYLRDLECKSVPNPQYMSHQDDLEWKTRGILIDWLIEVHTRFHLLPETLFLAVNIIDRFLSEKVVQLDRLQLVGITAMFVASKYEEVLSPHIANFRHVADDGFTEAEILSAERFILSTLNYDLSYPNPMNFLRRISKADNYDIQSRTLGKYLMEISLLDHRFMPYRPSHVAAAAMYLARLILGRGEWDKTIAYYAGYTEEEIEPVFHLMVDYLARPVIHEAFFKKYGSKKFLKASILTRQWAKKNAVLYGVVDAEIPLDKLKDRPVDQLP

SEQ ID NO: 17847 - protein, 503 aa, Pseudomonas putida KT2440
MRYPMKDSSDTHPNHLPDSCYGLFIDNQWVTAEYGETLDIINPANGKILTNIPNATAADVDRAVQAAQRAFVTWRTTSPAERANALLKIADLLEADADRFAVLETLDVGKPIRESRSVDIPLAIDHFRYFAGVIRSQSDEAVMLDEQTLSIALSEPLGVVGQVIPWNFPLLMAAWKIAPAIAAGNTVVIKPSELTPVTILELAKIFAKVLPAGVVNIVTGLGTTVGQALLDHPDLRKLAFTGSTRVGELVANAAAKKIIPATLELGGKSANIVFPDANWDKAVEGAVLAILWNQGQVCESGARLFVHESIYERFLAELKHKFEAVRVGDPLNPDTMMGAQVSKTQMERILGYVDIAKEEGAEVLIGGGRLTGADYDAGFFIQPTILVGVRNDMRVAYEEIFGPVLCVIPFKDEAEVIAMANDSEYGLAGAVWTQDINRALRVARAVETGRMWVNTYHEIPAHAPFGGYKKSGLGRETHKSMLEAYSQKKNIYVSLNEAPLGLF

SEQ ID NO: 17848 - protein, 347 aa, Schizosaccharomyces pombe
MKGSHPNAGSLLEPLHKLNPFSENSTSGHRKNASDHSADGETRPIAIEMKDSKGNTVPVGNSRPSKASNWLAGLMEDKNQRWRRSMEDTHICLYDFGGNQDDGFVAVYDGHAGIQASDYCQKNLHKVLLEKVRNEPDRLVTDLMDETFVEVNSKIAKATHNDICGCTAAVAFFRYEKNRTRRVLYTANAGDARIVLCRDGKAIRLSYDHKGSDANESRRVTQLGGLMVQNRINGVLAVTRALGDTYLKELVSAHPFTTETRIWNGHDEFFIIACDGLWDVVSDQEAVDFVRNFVSPREAAVRLVEFALKRLSTDNITCIVVNLTRNPGDLDDSGLTADNDSYSNDYY

SEQ ID NO: 17849 - protein, 747 aa, Aspergillus oryzae
MANIVAGGLHKVQEAVQGAASKDKKLVDLAPDTHNVQSSKEPLTTDHGVRISDTDHWLKEVNDNHTGPMMLEDQIAREKIHRFDHERIPERVVHARGTAAFGNFKLHESAEDVSYAGILTDTSRNTPVFLRFSTVQGSKGSADTVRDVRGFAVKFYTDEGNWDLVGNNIPVFFIQDAIKFPDFVHAVKPEPHNEVPQAQTAHNNFWDFVYLHPEATHMFMWAMSDRAIPRSYRMMQGFGVNTFSLINKEGKRHFVKFHFIPHLGVHSLVWDEALKLAGQDPDFHRKDLMEAIDNGAYPKWDFAIQVIPEEKQDDFEFDIFDATKIWPEELVPLRVIGELELNRNVDEFFPQTEQVAFCTSHIVPGIDFSDDPLLQGRNFSYFDTQISRLGINWEEIPINRPVCPVLNHNRDGAKRHRIAQGTVTTWSNRSEAGPPAPVEHGGFASYPAKLNGIKKRGLSPKFREHHNQAQLFYNSLSEHEKVHVKKAFGFELDHCDDPIVYERLAGHRLAEIDLTLAQEVAELVGAPIPDKALRPNHGKRSKHLSQTEFPGKQPTIASRRIAIIIGDGYDPVAFNGLKGAITAVGALPFVIGTKRSPIYADGEDKSSSKGVIADHQYDGQRSTMFDATFIPGGPHVESLKANGQIRYWIIETFGHLKALGATGEAAAFIKEALGSALDVKVATSDNPQPVEWYGVVTAGKIHKPESFKEGIQIVKDAKDFISTFFYQISQHRNYKRELDGLASTVAF

SEQ ID NO: 17850 - protein, 321 aa, Escherichia coli
LPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVMVGAMRPSTSMSADGPFNLYNAVTAADKASANRGVLVMNDTVLDGRDVTKTNTTDVATFKSVNYGPLGYIHDGKIDYQRTPARKHTSDTPFDVSKLNELPKVGIVYNYANASDLPAKALVDAGYDGIVSAGVGDGNLYKTVFDTLATAAKDGTAVRSSRVPTGATTQDAEVDDAKYGFVASGTLNPQKARVLLQALTQTKDPQQIQQIFNQY

SEQ ID NO: 17851 - protein, 167 aa, Sesamum indicum
RATFISHGNTARLAKEHGDLKLAQICGIIAADEKRHETAYTKIVEKLFEIDPDGTVLALADMMRKKVSMPAHLMYDGRDENLFDHFSAVAQRLGVYTAKDYADILEFLVARWEVEKLTGLSGEGRKAQDYVCGLPPRIRRLEERAHARAKQASPVPFSWIYGREVKL

SEQ ID NO: 17852 - protein, 447 aa, Gigartina radula
  unsure (1)..(447): unsure at all Xaa locations
ALFRVSPQPGVDAVEASAAIAGESSTATWTVVWTDLLTACDLYRAKAYKVDSVPNTTDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKXXXXXXXXXFMRWKERYLYSMEAVNRSIAASGETKGHYLNVTAATMEEMYERAEFAKQLGSIIIMIDLVIGYTAIQTMAVWSRKNDMILHLHRAGNSTYSRQKIHGMNFRVICKWMRMAGVDHIHAGTVVGKLEGDPLMIKGFYNTLLLPYLDVNLPQGIFFEQDWASLRKVTPVASGGIHCGQMHQLLDYLGIDVVLQFGGGTIGHPDGIQAGATANRVALESMVIARNEGRDYVAEGAQILQDAAKTCGPLQTALDLWKDITFNYTSTDTADFVETPTANV

SEQ ID NO: 17853 - protein, 348 aa, ASPERGILLUS NIDULANS FGSC A4
MSTFPAEPRSDIVNGHVESDFNYQTGTWSEPVFVQDHYLKVHGLAPGLNYGQQVFEGMKAYRDPNGQIQIFRPTDHALRMQRSCDAVSIPSIPESLFWASVNLAVAKNSEFVPPHASEAAMYIRPLAFGSGGWMPVAAGPQYKFVVYALPFCAYHGTLPVDAVVLEELDRAAPLGVGNVKVGGNYAPVLKWSDKARKEGFGITLHLDSKTRGEIDEFSTSGFVGIKYTESGGEKGYTLVVPNSQCIIKSVTSTSVVEVARSLGWRVEVRPIPYDELEFFDEVLAVGTAAMITSIRSITHRSKDQVFRYKTSDEPGSACEKLSRHLKGIQKGDEKDTFGWLKRVEEVTV

SEQ ID NO: 17854 - protein, 404 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 17855 - protein, 170 aa, Prochlorococcus marinus subsp. pastoris str. CCMP1378
MSRSLDLPSTEGVDTLAQELAKLQDNGKRRIAFLGSRHVPVVDIHLIELIARSLAEEGHTILTSGSQGVNAAVIRAVLGINPSLLTVLLPQSLDKQLPEIKNQLESVIHLVEKSENDELPLPMASSLCNQEIINRCDQLICFAFHDSETLLNSCRCAEEMGKVVSLLFFD

SEQ ID NO: 17856 - protein, 488 aa, Trichodesmium erythraeum IMS101
MTSKLKFRINKTKNRRLLSAKYSRFLEPTKLINYLSRTKWFSPTKLACIPLLCLIIALWAGAANAQDQELTPEYIKGVLDAIWILVASVFVIFMNAGFGMLESGFCRQKNTVNILAKNLIVFAIATLVYWSIGFSIMFAGDHPFIGAGGFFLTGESSTYGLNPFPAGLPVPVFFLFQAAFAATAATIVSGAVAERVEFLAFLLFSILITGISYPITGHWIWGSGGWLGAMGFKDFAGSTAVHSVGGWAALVGAYILRPRRGKYDEKNQPQAIPGHNMGFATLGCLILWIGWFGFNPGSQLAADENVVYIAVTTNLAAAAGGATAAITSWSKDKKPDLSMIINGVLAGLVGITAGCDGVSYLEAVIIGSIAGMIVVFSVSFFDKLTIDDPVGAISVHLICGIWGTLAVGIFVEDTSIITQFIGIISVGLFTVILSSIFWLALRATVGIRVHPEQEYKGLDISEHGMEAYHGFVKEPDSLATGVSHDHIQ

SEQ ID NO: 17857 - protein, 561 aa, Brucella suis 1330
MTSKPNVRTGGQILVDALRIHGADRVFCVPGESYLAALDAFHDASDAIDLIVCRQEGGASYMAEAYGKLTGKPGICFVTRGPGATNASIGVHTAFQDSTPMLLFIGQVASDQVEREAFQEIDYRRMFGQMAKWVVQIDDAARIPELVSQAFHRAVNGRPGPVVVALPEDMLTSYAAVSDAPAYKQVAMHPGGEQLQAMRALIEKAERPLMIVGGGGWTQDAVRDLRQFAENMSLPVAASFRCQDMFDNTHPLYAGEMGTSISARLVQRVKDSDLLVVVGARLGEMTTQGYELVTIPVPQQKLVHIHPGAEELGRVYHADVPINAGMPAFCAAAAKLAPVADPRWKAWADSANADYRDNIKSPVIPGEVQMGEVMEWLRAHLPADAIITNGAGNYSAWPHRFYQYRTYRSQLAPTNGSMGYGVPAAVAAKLTAPERTVVAFAGDGCFLMNGQELATAAQYGANAIFIVVNNGMYGTIRMHQERTYPARISGTALANPDFAALARAYGLHGEVVEKTADFAPAFKRCEQSGKPALIEIRIDPEALSPKMSLSQMREQGFAKQR

SEQ ID NO: 17858 - protein, 324 aa, Arabidopsis thaliana
HPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 17859 - protein, 496 aa, Avicennia marina
MPTRQLFIDGEWREPVQRKRIPIINPANEQTIGDIPAATAEEMDIAVEAARKAFFRNSGKDWSSTTGAHRAKYLRAIAAKIKDRKVELVELEAIDSGKPLEEASLDMDNVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIATTFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAVELANDTHYGLAAAVISKDLDRCERMAKAFQVGAVWVNCSQPCFYQAPWGGKKRSGFGRELGERGLDIYLNVKQVTRYVSSEPWGWYKSP

SEQ ID NO: 17860 - protein, 538 aa, Lycopersicon esculentum
MANDLQVLNALYVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAILKQKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGIGVRNSLIVLGCVNFLGMLFTFLVPESNGKSLEDLSRENEGEEETVAEIRATSGRTVPV

SEQ ID NO: 17861 - protein, 223 aa, Oryza sativa (japonica cultivar-group); identical to SEQ ID NO: 2292

SEQ ID NO: 17862 - protein, 397 aa, Zea mays
MDGGGQPPDTEMTDAGAGGGGQPSPPQQPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPPLREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEGDLDFVNENARRYIRQLPRHPRQSLPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 17863 - protein, 522 aa, Candida tropicalis
MSIQDIVETYSTKWYVVVSVALIVYKVFDFFYARYLMYKLGAKPFLQSQTDGYLGFRVPFELMGKKSEGTLIDFTYQRTLELDNPDIPTFTFPIFSVSIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 17864 - protein, 297 aa, Arabidopsis thaliana
MEARIILLRIQIPWSANRQFSHPPLDFPRFIRASSSSTSQKPKTYEGPKPRKNLVADFISKNDDLVRSLPIYVGGASLLAVLFNRTVSGIAPVADASSSQSRADLLALGLAVTNLLTGLVWLSIRPKSITPVNPKGVECKVVESDLPASMVSELLWAWESLKVATCCKSLVIVYNGICLIQIGMVAESPEDKKTVIVKTDKLMQGSVYRGVMKSKAQSYLANLSLYPGRSELPFLPANTQAVILQPLGDKGIAVIGGNTIRGFTSSDQAWISSIGEKLDATLGRYFVDSDEISRVTV

SEQ ID NO: 17865 - protein, 596 aa, Arabidopsis thaliana
MDSAKGWFQKRQMRGGSRYKGASGGAGGGGSNGSADEHNVETDEEAVSNTTKQKVAAAKQYIENHYKEQMKILQERKERRSMLEQKLADADVSEEDQNNLLKFLEKKETEYMRLQRHKLGVADFDLLTMIGKGAFGEVRVCREKTTGQVYAMKKLKKAEMLRRGQVEHVRAERNLLAEVDSNYIVKLYCSFQDDDHLYLVMEYLPGGDMMTLLMRKDTLTEEEAKFYVAETVLAIESIHRHNYIHRDIKPDNLLLDRYGHLRLSDFGLCKPLDCSAIGENDFSNNSNGSTEQEAGSTAPKRTQQEQLEHWQRNRRTLAYSTVGTPDYIAPEVLLKKGYGMECDWWSLGAIMYEMLVGYPPFYSDDPMSTCRKIVNWKSHLKFPEEAILSREAKDLINSLLCSVRRRLGSKGADELKAHTWFETVDWDTIFDMDAAFVPEVNDDLDTQNFEKFDESESETQTSSKSGPWRKMLSSKDINFVGYTYKNFEIVNDYQVPGMGTHLLDHCGVEEEEKVDATNGQVTLRYPTTSFTGPKFGYFHVNLEYNGSSETSDSSETTSRPPCDRPPPAPPVVQGSFLKLLPPELEVRPKQEGSEAC

SEQ ID NO: 17866 - protein, 367 aa, Pichia angusta
MPAASKNVVMIDNYDSFTWNLYEYLCQEGANVEVFRNDQITIPEIEQLKPDVVVISPGPGHPRTDSGISRDVISHFKGKIPVFGVCMGQQCIFEEFGGDVEYAGEIVHGKTSTVKHDNKGMFKNVPQDVAVTRYHSLAGTLKSLPDCLEITARTDNGIIMGVRHKKYTIEGVQFHPESILTEEGHLMIQNILNVSGGYWEENANGAAQRKESILEKIYAQRRKDYEFEMNRPGRRFADLELYLSMGLAPPLINFYDRLEQNISAGKVAILSEIKRASPSKGVIDGDANAAKQALNYAKAGVATISVLTEPTWFKGNIQDLEVARKAIDSVANRPCILRKEFIFNKYQILEARLAGADTVLLIVKMLS

SEQ ID NO: 17867 - protein, 441 aa, Oryza sativa
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 17868 - protein, 348 aa, Petunia x hybrida
MKTAQGVSATLTMEVARVQAIASLSKCMDTIPSEYIRSENEQPAATTLHGVVLQVPVIDLRDPDENKMVKLIADASKEWGIFQLINHGIPDEAIADLQKVGKEFFEHVPQEEKELIAKTPGSNDIEGYGTSLQKEVEGKKGWVDHLFHKIWPPSAVNYRYWPKNPPSYREANEEYGKRMREVVDRIFKSLSLGLGLEGHEMIEAAGGDEIVYLLKINYYPPCPRPDLALGVVAHTDMSYITILVPNEVQGLQVFKDGHWYDVKYIPNALIVHIGDQVEILSNGKYKSVYHRTTVNKDKTRMSWPVFLEPPSEHEVGPIPKLLSEANPPKFKTKKYKDYVYCKLNKLPQ

SEQ ID NO: 17869 - protein, 665 aa, Bacillus anthracis str. A2012
MNKKMEQLKHHVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDAVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINKEGKAHFVKFHWKPALGVHSLVWDEAQKIAGKNPDFHRQDLYEAIEKGDYPEWELGLQLIPEEDEHTFDFDILDPTKLWPEEEVPVKLVGKMTLNKNVDNFFAETEQVAFHPGHVVPGIDFSNDPLLQGRLFSYTDTQLSRLGGPNFHQTPINQPVCPFHNNQRDGMHQMQIHRGQTSYHPNGLNDNQPATVQAEQGGYEHYQEKIDGHKIRGRSKSFLNFYSQAKLFYNSMSPIEKQHIKEAFCFEVGKCKSDMVKANVIALLNHVDRQLAQEVANIIGAPLPKENHEVNSDAKSPALSMSNTIFKADSKNVAIVLNGDPSVSLLSEWIQAFAQHRINYSIVDNKIYQFNNSIKVTDTYTTTDSSLFDAVLVFSSESAIHPPVLEFAETTFKHFKPIAHVLSNPHALDNSKIKLDGAGIYNLANTSIESFIEGIAQGRFWNR

SEQ ID NO: 17870 - protein, 159 aa, Glycine max
MDFRVMGLDSPLFHTLQHMMDMSEDAAGDNKTYSAPTRSYVRDAKAMAATPADVKEYPNSYVFEIDMPGLKSGDIKVQVEDDNVLLISGERKRDEEIEGVKYLRMERRIGKFMRKFVLPENANTDAISAVCQDGVLSVIVQKLPPPEPKKPKTIEVKVA

SEQ ID NO: 17871 - protein, 273 aa, Oryza sativa
  unsure (1)..(273): unsure at all Xaa locations
MEERLADAEGGFACNSRGEDDFRSCCGDEDEWEDTEESFTAGVAKGELDESSVRLFFKGVSSPEAEGKKLSGIGVVMERSPGVPMLQVQKKLDFYVDELVADHLALMDGLSVALQNGIRKIFAFTNSEKLYFQIAEAEILEDQLLVALGHRILELVEKLEDFDIILLPSFELERPLQLAKEAIGIMYLSPYEVGTCSICCEEKRGAQMIKVGCAHTFCYSCLTSYTQEKLQTSXVPVRCPQFRCIYHISASECKSFLPVSCYDSLERAFAEAG

SEQ ID NO: 17872 - protein, 638 aa, Zea mays; identical to SEQ ID NO: 1569

SEQ ID NO: 17873 - protein, 375 aa, Xanthomonas campestris pv. campestris str. ATCC 33913
MLTLVLVVILAALVFEFINGFHDTANSIATVVATKVLSPGWAVMLAAGMNLIGALTGTAVALTIASGLLNTNVVDVTPQVILCALLGGIIWNLITWWKGLPSSSSHALIGGLCGAGLAAAHNNWDALIWSENIGNWAKNKGLLWKVFVPMITSPIAGFLLGIVVMLLLWALIAGMAKLGGPIGRLARPRWVNAFFGKAQIASAAYMGYAHGHNDAQKTMGIIAMTLIGAQSAGALDDLPSWLSFLHPGTGLAAGAGIPMWIVLTCAVVMAAGTASGGWKIIKTLGHKMVKLHPIHGFAAETSSATVLTVAAHFGMPVSTTHSISTAIMGVGFAKNPRSLRLGVIERIVWAWILTIPAAGGVAYLILRGFELFGWT

SEQ ID NO: 17874 - protein, 295 aa, Photobacterium profundum
MHAKIMDALGSLPSDLASAVKPIFEDANFDATLSPEQFTTLLSTTHMTDSELRVALLPIAAAYSVAPISKFFVGAIVRGESGRLYFGANMEFVGASLSQTIHAEQSAISHAWIKGETGITDITINYSPCGHCRQFMNELTTAKTLIVQLPEREEQTLQQYLPESFGPADLNITDALLGKIDHGMTIKETDEFVAIACKAANGSHAPYTKNYSGVALKATDGKVFTGKYAENAAFNPSLPPLQVALVNMNMAGYALTEIAEAALVEKADSTISHLSDTQTTLEALNPDIPLTYVAA

SEQ ID NO: 17875 - protein, 441 aa, Coxiella burnetii RSA 493
MTNQVQNPTLESLDEQKLNRLHWRMVITAGTGFFTDAYDLFVIGVVTALLMPLWHLSASQIALLNGASLASAAVGAVMFGWFADKFGRKKMYGIEVLILFIGALLSAVSPSFAWLLVSRIIVGIGIGGDYPTSAVVASEYANRKNRGFLVLLVFAMQAVGLIIGPLFASLLMAFHLPHALVWRLLLAFGALPAASVFYLRRRIAETPRFLLNKSPVEVSRVVSDLAGHSDTAVATPVQKLFSPKWLKCLIGTAGAWFLLDVALYGNGVSSVLIMKAISPHASLLKHTLLSALIFLCFAVPGYFSAATYVDKIGRKTLQIAGFVMMGLCYLLIAGIPHISDQLPLFVGIFGISFFFINFGPNATTFLIPSEIYPIHLRARAHGLSAAVGKAGAFIGAFFLPLLLKNMGLAYTMAVVAIASFLGIFATFLVPEMKGVSLEKPQ

SEQ ID NO: 17876 - protein, 320 aa, Burkholderia fungorum
MIHLTDAQIDELINIDDAIPALERGFRGLANGHAAVQQRVRTEADGVKLSTLGAVVPELGVAGAKVYSTIAGRFNFSIVLFSTVDGSLLATLEANAITRLRTAATTVVAVRALARQQATTAAIFGTGVQGRAHALALAAHTQLRSFRIVGLEGTEELAAEVSAAGASRGVEAVVSDAADAVRGADVIVTATRATGALFDGTTVAQGALVAAIGSSLPHTRELDDALIARASRIVVELRDQARQEAGDLVLAKPGTFSWEDTVELGNVLVGSEKGRVRDDDVIVYKAVGIGLQDIVLAGIAWEKHVSRNMIRLRGELQGLQ

SEQ ID NO: 17877 - protein, 320 aa, Prochlorococcus marinus subsp. marinus str. CCMP1375
MFEKMNWLLMVLPFALWGSAMAAMAPLVQSSGPEFVAILRLFPSGIAILIAVIILKRPLNIARIDLGWFLVFTLIDGSLFQFFLTRGLVNSGAGLGSVFIDSQPLIVALLARTLFGDPINPIGWIGLVLGLGGIICIGTPPELLSHWFLMNKGVSESDVLANGQFWMLGAALAMALGTVLIRFTCKASDPVAVTGWHMVFGSIPLAVWHFFDKSWPLFPQWSAFDWGLMSYAAFLGSALAYGLFFWFASQTELTSFSTLAFLTPVFALITGGVWLGERLDWVQWIGVSFVLFSVFLVSQRARLWEPISDSRNNLFKGISG

SEQ ID NO: 17878 - protein, 260 aa, Pyrococcus furiosus DSM 3638
MAFVPPQAGYDRAITVFSPDGRLFQVNYAREAVKRGATAVGVKCGEGVVLAVEKRITSRLIEPDSYEKIFQIDDHIAAASSGIIADARVLVNRARLEAQIYRLTYGEPAPVSVIVKKICDLKQMHTQYGGVRPFGAALLMAGINDRPELYETDPSGAYFAWKAVAIGSGRNTAMAIFEEKYRDDMNLEDAIKLALMALAKTMENPSADNIEVAVITVKDKKFRKLTRDEIEKYLSEVLKEVEEEEVKEKEEDYSELDSNY

SEQ ID NO: 17879 - protein, 265 aa, Fusobacterium nucleatum subsp. vincentii ATCC 49256
MTTLDGQEFFAGDYNTKFTIQSISKIISLMLAILDNGEEYVFSKVGMEPSGDPFNSIRKLETSSRKKPYNPMINAGAIAVASMIKGKDDREKFLRLLDFAKLITEDDTLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGYLLADLSEKLSLNIF

SEQ ID NO: 17880 - protein, 545 aa, Staphylococcus aureus subsp. aureus MW2
MNKDKQLHNDKINLSQLVLLGLGSLIGSGWLFGAWEASSIAGPAAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIVVALIFYYIGTTSSFESVYFRRATRINTKMRESLNNESKSSH

SEQ ID NO: 17881 - protein, 533 aa, Pseudomonas aeruginosa UCBPP-PA14
MKLLAFRRLLRIQRVVIRYRLDDLILELPMLPWWLRLLGATLPWRWLPRRKLELTRGARLRLALQDLGPIFIKFGQILSTRRDLLPDDIANELAWLQDKVPPFPPELAVKRIEEQLGAKIEQVFARFEREPLASASVAQVHAARLKSGEEVVVKVIRPNLEPVIRSDIAWLFILARLAERVSSEARRLHPVEVVSDYEKTIVDELDLLREAANASQLRRNFEGSPLLYVPQVYWDWCRPKVLVMERIYGIPVTDLETLRDQRTDFKALAERGVEIFFTQVFRDSFFHADMHPGNIFVSTRAPWSPQYIAVDCGIVGSLTDEDQDYLARNLIAFFKRDYRKVAQLHIDSGWVPAETKVNDFEAAIRTVCEPIFEKPLKDISFGQVLLRLFQTARRFNMEIQPQLVLLQKTLLNIEGLGRQLYPELDLWATAQPFLERWMRERVSPKQLLRNFQQQVEQVPHLSQMARDTLERLSQPHAHNAPPPEWKGSRHDWLGRLVGAVLLVGAAEVGLGQQLEAWPAWVMLAGGVFLILRR

SEQ ID NO: 17882 - protein, 408 aa, Leptospira interrogans serovar lai str. 56601
MANINENYLKLKAGYLFPEISKRVKIYSEKNPSAKIIRLGIGDVTLPIVPSVVDAMVEASKEMGTVGGFHGYGPEQGYSFLLKSIADHDYGSLGIKIDESEIFVSDGSKCDCGNIQEIFSTDSKIAVADPVYPVYVDTNVMAGRTGEIGPDGRYSNLIYMPATKENGFQPEIPKEKADIVYLCYPNNPTGTVTTKESLKAWVEYAKKNNSIILYDSAYEAFISEPGVPRSIYEVEGAKEVAIEFRSFSKTAGFTGLRCAYIVIPKELKGKTRSGEEVSLNSLWNRRHTTKFNGVSYVTQKGAEACYSPQGKKEIQTSIAYYMANASKIRDGLKKAGYEVFGGVNAPYIWLKTSDNLSSWDFFDKLLNKAQVVGTPGSGFGPAGEGYFRLSAFGKKEDVEEAIARITSL

SEQ ID NO: 17883 - protein, 147 aa, Escherichia coli CFT073
MSTIKVRCEQMANKPSAEELKKNLSEMQFYVTQNHGTEPPFTGRLLHNKRDGVYHCLICDAPLFHSQTKYDSGCGWPSFYEPVSEESIRYIKDLSHGMQRIEIRCGNCDAHLGHVFPDGPQPTGERYCVNSASLRFTDGENGEEING

SEQ ID NO: 17884 - protein, 469 aa, Proteus vulgaris
MSLEHVLSMIEEHKVRYIDLRFTDTRGKEQHLTIPAHQVNDDFFEEGKMFDGSSIGGWKGINESDMVLMPDASTAMLDPFFQDPTLIIRCDVLEPGTMQGYDRDPRSISKRAEDYLKSSGIADTVLFGPEPEFFLFDDIRFKNDISGASYAINDIEAAWNTNTKYEDGNKGHRPMVKGGYFPLPPVDSSQDIRSTMCNIMEEMGLVVEAHHHEVATAGQNEVATRFNTMTKKADETQIYKYVVQNVAHVFGKTATFMPKPLVGDNGSGMHCHMSLSKNGTNLFAGDKYGGLSEMALYYIGGIIKHARALNAFTNPTTNSYKRLVPGFEAPVMLAYSARNRSASIRIPVVASMKARRIEVRFPDPLANPYLAFAAQLMAGLDGITNKIHPGDAMDKNLYDLPPEEAKEIPTVAGSLEEALNALDADREFLTHGGVFTNDSIDAYLALLRTDVQRVRMAPHPLEFEMYYSA

SEQ ID NO: 17885 - protein, 575 aa, Oryza sativa
  unsure (1)..(575): unsure at all Xaa locations
MQGSSTSILHFVPSDPTSTSVLDFLSPTPRGTSPVHDRRLHAXGDLALRAGGDRLLVADTVAAVVESLVQAWRQVRMELLVPLLRGAVVACMVMSVIVLAEKVFLGVVSAVVKLLRRRPARLYRCDPVVVEDDDEAGRASFPMVLVQIPMYNEKEVYQLSIGAACRLTWPADRLIVQVLDDSTDAIVKELVRKECERWGKKGINVKYETRKDRAGYKAGNLREGMRRGYVQGCEFVAMLDADFQPPPDFLLKTVPFLVHNPRLALVQTRWEFVNANDCLLTRMQEMSMDYHFKVEQEAGSSLCNFFGYNGTAGVWRRQVIDESGGWEDRTTAEDMDLALRAGLLGWEFVYVGSIKVKSELPSTLKAYRSQQHRWSCGPALLFKKMFWEILAAKKVSFWKKLYMTYDFFIARRIISTFFTFFFFSVLLPMKVFFPEVQIPLWELILIPTAIILLHSVGTPRSIHLIILWFLFENVMALHRLKATLIGFFEAGRANEWIVTQKLGNIQKLKSIVRVTKNCRFKDRFHCLELFIGGFLLTSACYDYLYRDDIFYIFLLSQSIIYFAIGFEFMGVSVSS

SEQ ID NO: 17886 - protein, 196 aa, Mitthyridium sp. Wall 3797
GGAKKVVIFAPSKNPPMFVMGVNEEKSTNEDIVSNASCTTNCLAPFAKVINDKFGILEGLMTTVHPTTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDRFVNS

SEQ ID NO: 17887 - protein, 251 aa, Neurospora crassa
MARRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGYTQHGGLRPFGVSFIYAGWDPQRQFQLYLSNPSGNYGGWKATSAGANNASAQSLLKQDYKEDCTLKEACAMAVKVLSKTMDSTKLSPEKIEFATVGQTKDGKIYHRLWSADEITALLKEHDLAKDDNTEDK

SEQ ID NO: 17888 - protein, 471 aa, Gelidium latifolium
  unsure (1)..(471): unsure at all Xaa locations
SGVIPYAKMGYWDPDYAVKETDVLALFRVTPQPGVDPVEASAAVAGESSTATWTVVWTDLLTACDLYRAKAYKVEEVPNSSDQYFAYVTXXXXXXXXXXXXXXXXXXXXXXFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVHVVLQFGGGTIGHPDGIQAGATANRVALEAMVXARNEGRSFVEEGPQILRDAAKTCGPLQTALDLWKDISFNYTSTDTADFVETPTANV

SEQ ID NO: 17889 - protein, 478 aa, Zea mays
MAGGGAAYQSSSASPDWLNKGDNAWQMTSATLVGLQSMPGLVILYGSIVKKKWAINSAFMALYAFAAVWLCWVVWAYNMSFGDRLLPFWGKARPALGQRFLVAQSQLTATAVRYRDGSLEAEMLHPFYPAATMVYFQCVFASITVIILAGSLLGRMDIKAWMAFVPLWITFSYTVSAFSLWGGGFLFQWGVIDYSGGYVIHLSSGIAGLTAAYWVGPRSASDRERFPPNNILLVLAGAGLLWLGWTGFNGGDPYSANIDSSMAVLNTHICASTSLLMWTLLDVFFFGKPSVIGAVQGMITGLVCITPGAGLVQGWAAIVMGILSGSIPWYTMMVLHKKWSFMQRIDDTLGVFHTHAVAGLLGGATTGLFAEPVLCNLFLAIPDSRGAFYGGDGGSQFGKQIAGALFVIGWNIVITSIICVLIGLVLPLRIPDAQLLIGDDAVHGEEAYAIWAEGELNDVTRQDESRHGSVAVGVSQNV

SEQ ID NO: 17890 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 17891 - protein, 172 aa, Prochlorococcus marinus str. MIT 9313
MDLRHLIQDVPDFPKPGILFRDISPLLRDPDGWDEVMRQLGDLCTELKPDLIVGIESRGFIVGTALATNRKIGFVPVRKPGKLPGDVLGIDYSLEYGSDRLEIHADALQGHPRVLLVDDLLATGGTARATVELIEKAGGDLVGCGFVIELAALGGRQQLPVEIPVKSLIIYS

SEQ ID NO: 17892 - protein, 183 aa, Glycine max
  unsure (1)..(183): unsure at all Xaa locations
MQTSLLQIVGTPVISATYDQLQKSVNRYLPGPATQCQYSTTTSKQMRLRTNISETVKRKISLGARILXVEEGERLLKVSQCYLSTTSGPGPLAGFLFISTDKVAFCSERSMKVFTXKGHMLRIRYKVAIPLNKIKCVNQSQNVQKPTQKYIEIVTEDNFDFWFMGVLKYQKTFKYLEQAVSQA

SEQ ID NO: 17893 - protein, 213 aa, Brassica rapa
MVRGKTQMKRIENATSRQVTFSKRRNGLLKKAFELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKVQIEQLKQKEKALAAENKKLTEKWGSHEIEVWSNKNQESGRGDEESSPSSEVETELFIGLPCSSRK

SEQ ID NO: 17894 - protein, 499 aa, Glycine max
  unsure (1)..(499): unsure at all Xaa locations
MNSNGYPASSFKIPTVKFTKLFINGHFVDSLSGGEFETIDPRTGEVIARIAEGTKEDIDLAVKASRLAFDHGPWPRMPAVERARIMMKWADLIDQHVEEIAALDAIDAGKLYHMCKAIEIPATANTIRYYAGAADKIHGEVLKTSREFHAYTLLEPLGVVGHIIPWNFPSIMFVXKVSPCLAAGCTMVLKPAEQTPLSALFYAHLAKLAGIPDGVLNVVPGFGATAGAAISSHMDIDKVSFTGSTEVGREVMRAAANSNLKPVSLELGGKSPFIIFDDADLDKAVELALMAVVYNQGRXCAAGSRVFVQEGIYDEFEKRLVEKAKAWVVGDPFDPNVQQGPQVDKKQFEKILSYIEHGKREGATLLTGGKRVGNKGYYIEPTIFSNVKEEMLIAQDEIFDPVIALMRFKTIEEAIKSANKSRYGLVAGVVTKSLDTANTMSRSIRPGVVWINCYFAFENDIPYGGCKMSGFGKDSGLEALHKYLHVKSVVTPIYNSPWL

SEQ ID NO: 17895 - protein, 93 aa, Brassica rapa subsp. pekinensis
MAAAHGLVVQKTEEEWRAILSPEQFRILRQKGTEIPGTGEYDKFFEDGIFSCVGCKTPLYKSSTKFDSGCGWPAFFEGLPGAINRTPDPDGIS

SEQ ID NO: 17896 - protein, 479 aa, Apoglosssum ruscifolium
QVKNERYESGVIPYAKMGYWEPDYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLRGGLDFLKDDENINSQPFMRWKERFLYSMEAVNRSIAATGEVKGHYMNVTAATQEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIKGFYDTLLVSHLKVNLPQGIFFYQDWASLRKVTPVASGGIHCGQMHQLLDYLGDDVVLQFGGGTIGHPDGIQAGATANRVALESIVIARNEGRDYVKEGPQILLDAAKTCGPLQTALDLWKDITFNYTSTDTADFVETPTANV

SEQ ID NO: 17897 - protein, 925 aa, Medicago truncatula
MMELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 17898 - protein, 505 aa, GIBBERELLA ZEAE PH-1
MAHELPFKIPTLQVKQQAPSQVQPLTSSVILPSNSLTTLTTPDPGTNKPWAKVKDNSADDVDHTVQVAYDAFQTFKKTSPRLRAQWLLKWDALIREHKADLATLLVYETGKPYAEAIGEMDYSLTFTSWFAGEAERIQGTCFMPSAPNRRVFTIKQPLGVAVALVPWNFPVAMVLRKAAAALAAGCTMVVKPSPETPVTAMALAKLASEAGFPNGVLNILPTSLDNTPSLSEALCKHDLVKKVTFTGSTRVGTLVANLCSLGLKKVVLELGGNCPCLIFNDADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKMSGYGKEAGKDVAVNEYMIQKTGTITVDGLV

SEQ ID NO: 17899 - protein, 203 aa, Zea mays
RPTRPLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 17900 - protein, 112 aa, Glycine max
  unsure (1)..(112): unsure at all Xaa locations
FFLCRFSPGDTNMVLRNFENCGEILKHVLGPRDANWMHILYQNRSDAHRALIXXXXXXXXXLIVGVKLLDPMQRQALNERLKNQGFMPLPLPSARNSEVSSLKAPSRPYYLQ

SEQ ID NO: 17901 - protein, 365 aa, Saccharomyces exiguus
MAQTTKHIVVLPGDHVGQEITEEAIKVLNAISSVRPNVNFDFQHHLIGGAAIDATGVPLPDEALEASKKADAVLLGAVGGPKWGTGSVRPEQGLLKIRKELQLYANLRPCNFASDSLLDLSPLKPEIVKGTDICIVRELVGGIYFGERKEDEGDGVAWDSEKYSVSEVQRITRMAGFLALQHNPPLPVWSLDKANVLASSRLWRKTVEETIKNEFPTLTVQHQLIDSAAMILVKNPTHLNGVVIANNMFGDIISDEASVIPGSLGLLPSASLASLPDTNTAFGLYEPCHGSAPDLPKGKVNPVATILSVAMMLKLSLNMTEEGIAVEKAVKQVLDSGVRTADLRGSNSTSEVGDAIAKAVKEILA

SEQ ID NO: 17902 - protein, 477 aa, Paraglossum lancifolium
KNERYESGVIPYAKMGYWDPDYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARANDMILHLHRAGNSTYSRQKIHGMNFRVICKWMRMAGVDHIHAGTVVGKLEGDPLMIRGFYNTLLLPYLEVNLLQGIFFEQDWASLRKVTPVASGGIHCGQMHQLLDYLGDDVVLQFGGGTIGHPDGIQAGATANRVALESMVIARNEGRDYVPEGPQILRDAAKTCGPLQTALDLWKDITFNYTSTDTPDFVETPTANV

SEQ ID NO: 17903 - protein, 248 aa, Synechococcus sp. WH 5701
PIEKHHHEVAASGQQELGMFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSSEGVLAALEADHEYLLAGEVFSEDFISNWIALKSEALQ

SEQ ID NO: 17904 - protein, 387 aa, Pseudomonas fluorescens PfO-1
MTTTRNDWEQRFQSLTLESRAFINGEYRPAISGETFECLSPVDGRFLASVASTDEADANLAVEAARQSFNAGVWANKAPAERKRILIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALDAGIPKGVFNVLPGFGHTVGKALALHMDVDVLAFTGSTAIAKQLMIYAGQSNMKRVWLEAGGKSPNVVFADAPDLRAAAQAAAGAIAFNQGEVCTAGSRLLVERSIREQFIPLLVEALPSVETGARPGSGDHRRRRGRSASTGQRAALYQHRSGAGCRADRRRPTHPRRHRRHLHRADDF

SEQ ID NO: 17905 - protein, 403 aa, Nostoc punctiforme
MSLNWIVPAERIQKLPPYVFARLDELKAKAREQGLDLIDLGMGNPDGATPAPVVEAAIAALKDPANHGYPPFEGTASFRRAITNWYHRRYGVVLDPDSEALPLLGSKEGLTHLAIAYVNPGDLVLVPSPAYPAHFRGPAIAGGKIHSLILKPENDWLIDLAAIPDEVARQAKILYFNYPSNPTAATAPREFFEEIVAFARKYEILLVHDLCYAELAFDGYQPTSLLEIPGAKDIGVEFHTLSKTYNMAGWRVGFVVGNRHVIQGLRTLKTNLDYGIFSALQKAAETALQLPDVYLHEVQQRYRTRRDFLIDGLGELGWDIPRTKATMYLWVKCPVGMGSTDFALNVLQQTGVVLTPGNAFGVAGEGYVRISLIADCDRLGEALHRFKQAGIRYQPEAVVSASG

SEQ ID NO: 17906 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQSALEGMLDTL

SEQ ID NO: 17907 - protein, 313 aa, Pyrus communis
MATFPVVDLSLVNGEERVATLEKINDACENWGFFELVNHGMSTELLDTVEKMTKDHYKKTMEQRFKEMVAAKGLDAVQSDIHDLDWESTFFLRHLPSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGDWVDVPPMHHSIVINLGDQIEVITNGKYKSVMHRVIAQSDRDRMSIASFYNPGDDAFISPAPAVLEKKTEDAPTYPKFVFDDYMKLYSGLKFQAKEPRFEAMKAKESTLVATT

SEQ ID NO: 17908 - protein, 817 aa, Vibrio parahaemolyticus RIMD 2210633
MKPTQQKQFDKKSFQDSVKKHLSVTYAHTVENADSRAWYLAMGRALAEFTTFDLLATETDPRIQQAKSVNYLSLEFLIGRLTGNNLISMGLYEQVTEAMAELGHNLTDLLEEERDPSLGNGGLGRLAACFMDSCAAQEFPTVGYGLHYEYGLFKQSFKDGRQQEAPDAWRGVEGYPWEVARPELAQEIGFYGHVEVVNVDGKEVRKWVPGMSVKAMPWDLPIVGYESDTVYPLRLWECQAIAPFSLASFNNGDYFEAQHALIDAGNITKVLYPNDNHEKGKTLRLMQQYFHSAASVRDILRRHEAAGYSLADLPKQETIQLNDTHPTIAIPELMRILMDEKGLTWEAAWEISSKTFAYTNHTLLPEALETWPESLIQHLLPRHMEIIYEINHRFLQDVRAMWPGDVAKQQKLSIIEEGFHRMVRMANLCVIGSYAVNGVAALHSELVKKDLFPEFHEMYPTRLHNVTNGITPRRWLKFCNPGLSQLITEKVGAEWPAKLEQLEGIAKYATDATFQKEFMAVKKENKERLANWVKEHMGIELDTNAIFDVQIKRLHEYKRQHLDLLHVLSLYHRILNEPGFECTPRVVFFAAKAAPGYHLAKEIIFAINKIADKVNNDPRIGNKLKVVFIPDYRVSMAEIIIPAADVSQQISLAGKEASGTGNMKMALNGALTIGTMDGANVEIREEVGDENIYIFGLDVEGVKALKAQGYNPFDYYNADHLLKASMDLLLGEEFTPGQPGLLRATYDSLLDGGDPYLCLADFASYVKAHEEMGKQYKDQAGWAKKAILNTALVGKFTSDRSIRDYVNNIWKLEAVHR

SEQ ID NO: 17909 - protein, 222 aa, Pelargonium x hortorum
AEENRHGDLLNKYLYLSGRIDMRQIEKTIQYLIGSGMDPKTENNPYLGFIYTSFQERATFVSHGNTARHAKDHGDLKLAQICGTIAADEKRHETAYTKIVEKLFELDPDGTVMALSDMMRKKISMPAHLMFDGKDDNLFEHFSRSQRLGVYTARDYADILEFLVARWNVDKLTGLSGEGRRAQDYVCGLAQRIRRLEERAQKRAKEATMVPFSWIFGREVLL

SEQ ID NO: 17910 - protein, 250 aa, Zea mays
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGLRPFGVSFLFAGWDKHHGFQLYMSDPSGNYGGWKAAAVGANSQAAQSMLKQDYKDGLTREEAVALALKVLSKTMDSTSLTAEKLELAEVFLQPGSGEVQYQVCSPEALGKLLAKSGLTQPTPEA

SEQ ID NO: 17911 - protein, 514 aa, Triticum aestivum
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAAMLTLGALFVTDTPNSLIERGHLEEGKAVLKRIRGTDNVEPEFNEIVEASRIAQEVKHPFRNLLQRRNRPQLVIAVLLQIFQQFTGINAIMFYAPVLFNTLGFKSDASLYSAVITGAVNVLATLVSVYAVDRAGRRALLLEAGVQMFLSQVAIAVVLGIKVTDKSDNLGHGWAILVVVKVCTYVASFAWSWGPLGWLIPSETFPLETRSAGQSVTVCVNLLFTFLMAQAFLSMFCHLKFAMFILFSAWVLVISVFVLFFLPDTKNVPMEEMTDKVWKQHWLWKRFMDDDDQHHNIANGKNAPV

SEQ ID NO: 17912 - protein, 337 aa, Ustilago maydis
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKRVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 17913 - protein, 297 aa, Aeromonas hydrophila
MIRDKMKAVIPVAGLGTRMLPATKAIPKEMLPIVDKPLIQYVVNECIAAGLKEIILVTHSSKNAIENHFDKSFELEATLESRVKRQLLEEIQSICPKDVTIMHVRQGEAKGLGHAVLSAYPLVGNNPFVVVLPDVIIDDAASDLKKDNLAKMVRNYKESGHSQIMVEPVAIQDVSKYGIVDCHSVDISAGESATIFNVVEKPEKDEAPSNLAIVGRYVLTPEIWPYLRTTKPGAGDEIQLTDAISELLKDGQVDAFCMQGKSHDCGDKLGYMKAFVEYGLRHKDHQHNFRNFIVSLV

SEQ ID NO: 17914 - protein, 337 aa, Triticum aestivum
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMESEKKATSAIPRNKSDMLDGAGRAPQVENERHSAVL

SEQ ID NO: 17915 - protein, 439 aa, Pyrococcus furiosus
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFGYITKAVAEMHGLYATFMPKPLFGFPGNGLHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFSYVEENVYEMSEEKRKELGLETLPGNLGEALGELEKDKVVKEALGDSYKNFINYKWKEWESYLEYLEEKHIPPDTEKVTEWELERYFFL

SEQ ID NO: 17916 - protein, 366 aa, Chlamydomonas sp. W80
MMATAGSSAAGARVSMRAASGIRASSSSRRAAVVVKAANVNIGDSLAEFLAVATPDTKLRQLMTSMSEATRTIAHKVRTASCGGTACVNSFGDEQLAVDMVADGILFEALKYSHVCSYACSEEVPEPVAMGGSGYSVAFDPLDGSSIVDTNFSVGTIFGVWPGDKLTGITGRDQAAAGMGVYGPRTVFVIAINGFPGTHEFLLQDDGKWLLVKSTEEIGEGKLFAPGNLRAIFDNPEYSKLVSYYLEEQYTLRYTGGMVPDVFQILVKEKGVFTNVTSPSTKAKLRLLFEVAPLALLIENAGGASSCDGLVCRALDVEVTAHEQRTQICYGSKGEVARFEKYMLGESSASLTLSRPSKRPCAERAR

SEQ ID NO: 17917 - protein, 305 aa, Glycine max
VIDDVAGAGAESGDLKGETAPVDGLLNWQNARLKAEILTHPLYEQLLSAHVACLRIATPVDQLPRIDAQLAQSQNVVAKYSAFGQAIVGDDKELDQFLSHYVLLLCSFKEQLQQHVRVHAMEAVMACWEIEQSLQSLTGVSPGEGTGATMSDDEDEQVDSDANLFDGALDGPDSMGFGPLIPTENERSLMERVRHELKHELKQGYKDKIVDIREEILRKRRAGKLPGDTTSVLKAWWQSHSKWPYPTEEDKARLVQETGLQLKQINNWFINQRKRNWHSSPSTSTVLKSKRKRSNAGLNSADQYT

SEQ ID NO: 17918 - protein, 760 aa, Centella asiatica
MWKLKIAEGNGAYLYSTNNFVGRQIWEYDPDAGTPEERLEVEKLRETYKYNLINNGIHPCGDMLMRLQLIKESGLDLLSIPPVRLGEQEEVNYQVVTTAVKKALRLNRAIQAHDGHWPAENAGPMFFTPPLIIALYISGAIDTHLTIQHKKEMIRFIYLHQNKDGGWGFYIEGHSTMIGSALSYVALRLLGEGPDDGDGAVERARKWILDHGGAASIPSWGKTYLAVLGVYEWEGCNPLPPEFWLFPEALPYHPAKMWCYCRTTYMPMSYLYGKKYHGPITDLVISLRKEIHPIPYEKINWNKQRHNCNKEDLYYPHSFIQDLLWDGLHYFTEPIIKMWPFNKLRKKGMKRAIELMRYGGYESRFITIGCVSKSLDMMCWWAENPNGPEFKHHLARVPDYLWLAEDGMKMQSFGSQLWDCVLATQAVMSTGMVDEYGDCLKKAHFYIKESQCKKNPSGDYASMCRYFTKGSWTFSDQDQGWVVSDCTAEALKCLLALSQMPEEIAGEKADVERLYDAVNVLLYLQSPISGGFAIWEPPVPRPYLQVLNPSEIFADIVVEKEHTECTASIIAALVAFKRLHPGHRSKEISVAIAKAVHFLEGKQLEDGSWYGYWGICFLYGTFFALAGLASVGQTYENSETVRKAVKFFLSTQNEEGGWGESLESCPSEIFTPLEGNRTNLVQTSWAMLGLMFGGQATRDPTPLHRAAKLLINAQLNNGDFPQQETTGVYMKNCMLHYAEYRNVFPLWALGEYRKRLWLSN

SEQ ID NO: 17919 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACMGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 17920 - protein, 96 aa, Zea diploperennis
MGRRACCEKEGVKRGAWTTKEDDALAAYVKAHGECKWREVPQKAGLRRCGKSCRLRWLNYLRPNIRRGNISYDEEDLIIRLHRLLGNRWSLIAGRL

SEQ ID NO: 17921 - protein, 473 aa, Griffithsia japonica
YESGVIPYAKMGYWDPNYAVKETDILALFRVTPQPGVDPIEASAAVAGESSTATWTVVWTDLLTACDLYRAKSYKVEAVPNSSDQYFAYIAYDIDLFEEGSIANLTASIIGNVFGFKAVKALRLEDMRIPVAYLKTFQGPATGVIVERERMDKFGRPFLGATVKPKLGLSGKNYGRVVYEGLRGGLDFLKDDENINSQPFMRWKERFLYSMEAVNRSIAATGEVKGHYMNVTAATMEQMYERAEFAKQLGTVIIMIDLVIGYSAIQTMGIWARKNDMILHLHRAGNSTYSRQKSHGMNFRVICKWMRMAGVDHIHAGTVVGKLEGDPLMIRGFYRTLLESHLDINLPQGIFFQQDWASLRKVTPVASGGIHCGQMHQLVDYLGEDVVLQFGGGTIGHPDGIQAGATANRVALEAMIIARNEGRDYVAEGPQILQDAAKTCGPLQTALDLWKDITFNYTSTDTADFVETPTANV

SEQ ID NO: 17922 - protein, 340 aa, Zea mays
MESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWSNMYFRSFWKNAQSKGQISGDSPPDPSHFMRNGSSPGSNFTGKLDDNHNIVTSAAASGAQDQVETDHMASGCYRSAETTANFTNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 17923 - protein, 320 aa, Oryza sativa
MADEKLAKLREAVAGLSQISDNEKSGFISLVARYLRSVIEVRNGFTFLDLIVIQIESQYPRVVADEFLPWPSKGKTCKDGWYPPGHGDIFPSLMNSGKLDLLLSQVTPKTLADVKGGTLISYEDKVQDNFQPLCNCCFGDDNIFAFQLLEIAQVPDAHVHEFKSIEKFKIFNTNNLWVNLKAIKRLVEADALKMEIIPNPKEVDGVKVLKVETAAGAAIRSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 17924 - protein, 325 aa, Bacillus subtilis subsp. subtilis str. 168
MKYTFNEEKAFDIVAIGRACIDLNAVEYNRPMEETMTFSKYVGGSPANIAIGSAKLGLKAGFIGKIPDDQHGRFIESYMRKTGVDTTQMIVDQDGHKAGLAFTEILSPEECSILMYRDDVADLYLEPSEVSEDYIANAKMLLVSGTALAKSPSREAVLKAVQYAKKHQVKVVFELDYRPYTWQSSDETAVYYSLVAEQSDIVIGTRDEFDVMENRTGGSNEESVNHLFGHSADLVVIKHGVEGSYAYSKSGEVFRAQAYKTKVLKTFGAGDSYASAFIYGLVSGKDIETALKYGSASASIVVSKHSSSEAMPTAEEIEQLIEAQS

SEQ ID NO: 17925 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 17926 - protein, 181 aa, Zea mays
  unsure (1)..(181): unsure at all Xaa locations
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEXEHGFVYREHGNIPGYYDGRYWTMWNLPLFGCTDPPQVLKEVQQCKREYPNAFIRIIGSDNNRQAQCISFIPHKPPSFTDA

SEQ ID NO: 17927 - protein, 418 aa, Neurospora crassa
MADDVETQAEKAQPVTRSIHPVFYIASWIFFSNITILFNKWLLAPHRFSYPTILTCWHLIFATIATQVLARTTTLLDGRKSVKMTGRLYLRAIVPIGFLFSGSLVCSNMVYLYLSVAFIQMLKAAAPVAVLLTAWVWGVEQPSQSRLINVLFIVFGVGLASFGEIAFSLTGFLFQLGGIVFEAMRLIMIQVLLKGDGQKMDPLVSLYYFAPVCASMNFVVALFTEFRSFNIADLYNTGLWCLLLNAVVAFMLNISSVCLIGRTSGLVMTLTGILKNILLVVASVMIWQTSITPLQFLGYAIALAGLVYYSLGRDQIVEITTQFWTFLRGVWENSPAYSSVSSSSSDEGNGQQQGGGLPSAVRRALLMGLGVMVVVILAAGYIYSGADPSGGGAAVGVPRPLGGGGGDASSVKPVPVAS

SEQ ID NO: 17928 - protein, 418 aa, Solanum tuberosum subsp. andigena
MVRNRREELYVTVPSLFRCPISMDVMKSPVSLCTGVTYDRSSIQTWLSQGHNTCPATMQILPSTDFIPNLTLRRLINVWIQHQPSSSPGYTTPSSSSVTKSEVVEIVKNLNGEVDRLSSLAKIVEFVKCSGENRRFFVNSSDAIVSVVGVLVDCDVGEVCEAVVAVLDLVVSENGVKEQLNKEILKSDRKFLPKFLLILRKGKLSSRIQTARILEFIALDADSQRKMIEEQGLLYELHVFTSTETNRFAIEAGLSTLIAVSTTRPAKKELVRFGIVQTIGKILSGSETARAVVEKSLKLLETVATCTEGRAAIVKGEECMSAIVTRLMKSSKAATEHGVTVLWSVCCLFRDTAARDVVGKANGLTKVLLVMQSDCSAAVRQMCGELVKALRVVNNKHKNYSKSCLASYDTKTTHIMPY

SEQ ID NO: 17929 - protein, 452 aa, Eremothecium gossypii
MHVPLGLLVAMSWCAGSAATAVQMCNPLKEKKCPENIALAASILEEFKDVPPGFSNYTDTGIVGYGPNGASFTLAKRWDNPAIMSDFYLMYGKVEVTFKAAPGKGIVSSFYLQSDARDEIDLEWLGGDTAQFQTNFFCKGNVTTYTRGAFHNVSRPQEEFHTYTIDWKMDELVFYLDGKPIRRVKNDTSEGYPQSPMRLYMGVWAGGDPTNHPGTVEWAGGQTDYSKVPFTAYIKRIIASDYSSGRSYMYSDVSEKGVTIHSTQGKIYGRYDTAQEEFNRIQREEKLDYSDLPLSAFSPNLASGSSEATSVTSSATSVTSSATSVTSSAGSVTSGVTSSATTGVSSATATGNSTSGTQVSSSARASSDHSLAATLLSSGHSTSQLSSTTSLTPSKSTTPVLTSRGTVETTPSSTVTPDASSIASFPVSENGAKRSYMPLTYVAALGILSLMG

SEQ ID NO: 17930 - protein, 765 aa, GIBBERELLA ZEAE PH-1
MYDKLVPLGSRLHYPIIITKLLKKPGDSIKKQESIFEYKFNWRRRVNEDDWQDETTYTEFDSPAEGKLKQWRIREGQQVAADSPCLIVEEACGHEVQVQGLCSLCGADMTEINWASDNLDTDRAMINMSHDQTVLRVSESVATKAEHENQKRLLRQRKLSLVVDLDQTIIHACIEPTIGEWQRDPSNPNHDAVKDVKSFQLNDDGPRGVTSGCTYYIKLRPGLMEFLEEVSKMYELHVYTMGTRAYALNIAKIVDPDKKLFGNRVISRDENGSITSKSLQRLFPVSTDMVVIIDDRADVWPMNRPNLIKVVPYDFFKGIGDINSSFLPKRQDTLPILKAKPVDNGSKLAPKSSPMDELVKMSSGDDAASLKIQAEEQEKTLEKQIKERPLLHMQEELDKEDDQQETSSADSSGIHHRNVLVDDDEELIALQDHLTDLHTAFYETYDRRRAERKEKEEGTHPPPHSKSKRRPSVDDGVDLSMVPDAGDILDELKSNVLSGLVIVLSGLVPLGVRVEESEIGLQAQSYGAQVLDTVSKRVTHLVVSSARPRTKKVQQAAKIASIKIVNQNWLIDCLSQWRRLDERPYFLDILDADRERGIDDITEVTSEAEEAEDAQTGQELKDFDWGEAEDELAEFMDDDDDDDDEGSVAATVTESDVETVDGNNKQTLKRKADAEESDDDGTASIGESVLAKKQRLARNRGASSLRSIQTPNGDDTEDGSLPTPVPTGDEAAEDRDKEQTVNADDSADFDDDELERELLAELMAG

SEQ ID NO: 17931 - protein, 214 aa, Schizosaccharomyces pombe
METYEQEYRLLRADIEEKLNDLSKSGENSVIQSCQRLLNEIDEVIGQMEIEITGIPTSERGLVNGRIRSYRSTLEEWRRHLKEEIGKSDRKALFGNRDETSGDYIASDQDYDQRTRLLQGTNRLEQSSQRLLESHRIANETEGIGASILRDLHGQRNQLEHSLEMLGDTSGHLDRSLRTLKTMARRLAMNRFFTTAIIAILVILILLVLYSKFR

SEQ ID NO: 17932 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 17933 - protein, 374 aa, Brassica napus
MGKSEEPKVTKSDNKPSSPPADQTNVHVYPDWAAMQAYYGPRVAIPPYYNSAMAAASGHPPPPYMWNPQHMMSPYGTPYAAVYPHGGGVYAHPGFPMPQSQKGAALSTPGTPLNIDTPSKSTGNTENGLMKKLKEFDGLAMSLGNGNNGDEGKRSRNSSETDGSSDGSDGNTTGADEPKLKRRREGTPTKDEEKHLVQSSSFRSVSQSSGDNVVKHSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 17934 - protein, 595 aa, Oryza sativa
  unsure (1)..(595): unsure at all Xaa locations
MDSSSRGGGGEGSGSGSRGRSSRLERRNAVKHIDYEAAGAGAGAGASSVPACASWSSSMSADRSLGLRPSRSLDLAVGGGGTDIRISGSVEGEVDELCRSLGLSGPEEFAIPVAAWEARKERSNSDLLPRSRFVSSPPVDDPSPMARTIXAPEVIQCDLPPSFPASIPEESLNSSSNSTATDSAEEPTAAALGQESPKAAPAVAAVAPLAGLPLLSPKRGGGEVGIRGARPPVLSPPQPLMALAPPPMRRSIVAKDMSGVSAWDIVNSFAPSEEKSEVRTDDERVDASHMSDTEEEEEFADEGVAGVDGELKELRIGETFEGFTGTSSLSTTNDDDASSTTTEAMFIISPNGKFKRKIKSWMRGALLGSGSFGMVYEGISDEGAFFAVKEVSLLDQGSNAQQSILALEQEIALLSQFEHENIVQYYGTDKEESKLYIFIELVTQGSLSSLYQKYKLRDSQVSAYTRQILNGLVYLHERNVVHRDIKCANILVHANGSVKLADFGLAKEMSKINMLRSCKGSVYWMAPEVVNPKKTYGPQADIWSLGCTVLEMLTRNIPYPNVEWXERPQIPSYLSKDAQDFISQFRNQNNCGKRA

SEQ ID NO: 17935 - protein, 601 aa, Zea mays
MGPPPGAQDPAPSPSGGSGSSRRRFRRLDRRNASKHIAYDATNFCQYPPSPQAASAPGSGRASLASSAACSIDLVNSFRIGGSGDGGGDLRFLCENLGLSGPDDFAIPRADWEAHKAARSSASASSSPNPARPNYDSPQRNSPLSQVGAEEQEPAQASDAETELPAATGRDGPIEAPERPARLDLPLESTCPDARRAPGQGGIKGVRPPPVLKPPPSMALPAVCGVGSTWDILRSLAPDEKDDAPASRSGRRFGHQDAVEKDDDERAAVLLMLDDLRLEESSESFTGTSSLSTTNDDDTSSTTTESMFYISPNGRFRRRIKSWSRGVLLGSGSFGTVYEGISDEGVFFAVKEVNLFDKGSNAKQCIFQLEQEIALLSQFEHENIVQYYGTDKEDSKLYIFLELVTQGSLASLYHKYRLRDTQVSAYTRQILNGLIYLHERNIVHRDIKCANILVHANGSVKLADFGLAKEITKFNELKSCKGTVYWMAPEVVNPKQTYGPAADIWSLGCTVLEMLTRQIPYPDLEWAQALYRIGKGESPAIPNTLSRDARDFISRCVKPNPEDRPSASKLLEHPFVNKSIRSVRSMRTTPSRSNSSTRGIN

SEQ ID NO: 17936 - protein, 295 aa, Bacillus anthracis
MKIRKAIIPAAGLGTRFLPATKAQPKEMLPIVDKPTIQYIVEEAVSSGIEDIIIVSGRGKHVIEDHFDKSYELEQTLFKKNKIKTLEDIECISNLANIHYIRQKEPKGLGHAIYCARRFIGEEPFAVLLGDDIVSSTYPCLKQLIDVYEEHHCSVVGVQRVLETEVSKYGIVKSANQNVNQSIIPISMLVEKPPLETAPSNLAIMGRYILKPDIFEVLKNLPVGSGGEIQLTDAINVLNKQQKVLAFEFDGKRYDVGDKFGFIKATIDFALQRESLKEDVLSYLRNITRDKLINK

SEQ ID NO: 17937 - protein, 343 aa, Glycine max
  unsure (1)..(343): unsure at all Xaa locations
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLXAKVINDRFGIVEGLMTTVHSITATQKTVDGPSAKDWRGGRAASFNIIPSSTGAAKAVGKVXFPALNGKLTGMAFRXVPTVDVSVVDLTVRLEKEASYDEIKNAIKEESEGKLKGILXGYTEDDVVSTDXFVGDNRSSIFDAKAGIALNKNFVKLVSWYDNEWGYSSRVIDLLVIVAKKSF

SEQ ID NO: 17938 - protein, 300 aa, Magnetospirillum magnetotacticum
MRRSPARLTPLEWASATLVVTLWGLNFVAVKTALGTLPPFLLTALRFACTAAILAPFFRPTRGQLPGIALLALLLGIGHFGLMFFGVAGMDAATAAIVIELSIPFSAILAWAFFGEVLGIWRSLGLAVSFLGVALLAGEPHLPHLTPFLAVVASGFAWALANVVIKRIGPINPLALNGWMALLAAPMLLVLSLITEDGQSEALAATGVKGWSGVAYTIIGSTLIAYTLWYRLIARHPMNRVVPFTLLGPVVGLAGGVLLLGEPLTWHKLVGGALTVLGVAAVELLPGRAIHRAEEPEPGT

SEQ ID NO: 17939 - protein, 486 aa, Cycloclasticus oligotrophus
MQHINHFINGEFVSAVDGKSFEKRSPVDRRLIAQVSEGGKVDVDRAVHAARAALNGEWGAFTMEQRVEILYGVADEITRRFDDFVEAEMADTGQPKSIMTHAFIPRGAANFKIFADVIKNVPNESFQTTTPDGLGALNYAIRVPKGVVGVVSPWNAPFLLMTWKVGPALACGNTVVVKPSEETPLTTTLLGEVMNKVGVPKGVFNVVHGFGPDSAGEYLTHHPKVDAITFTGETTTGAAIMKAASEGMRDVSFELGGKNAGIVFADSDFDKAVDGIYKSSFLNSGQVCLGTERVYVERPIFDKFVEALKKKVEKVRHGRPDDENCNFGPMISHEHQAKVLSYYAKAVEEGATVVTGGGVPSIPEELKEGAWVEPTIWTGLAEDATVMKEEIFGPCCHIAPFDDEQQVINWANDTEYGLSTTVWTRDLSRAHRVAAKINVGITWINSWFLRDLRTAFGGSKQSGIGREGGVHSLEFYTETRNVCVKL

SEQ ID NO: 17940 - protein, 582 aa, Glycine max
  unsure (1)..(582): unsure at all Xaa locations
FEQQYDRFMNSFRSLENNTQGQPDKVVSLAKWRILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDRLYLGLRQPRLEGEEYLSIVDEFMEAVHARWPKAIVQFEDFQMKWAFETLKRYQKRFCMFNDDIQGTAGVALAGILGTVRAQGRPLTDFVNQKXIVVVGAXGGLGVLKMAIQTVAKISGCSELAAKSQFYLIDKDGLVTTERNSLDPAAAPFAKNPRDIXGLTEGASIIEVVKKIRPHVLLGLSGVGGIFNEEVLKAMRESVSTKPAIFAMSNPTMNAECTSIDAFKHAGENIVFASGSPFENVDLGNGKVGHVNQANNMYLFPGIGLGTLLSGAHLITAGMLQAASECLASYMAEEDILKGILYPSVDFYMYMGTAECTAIDAFKHAGENMVFASGSPFENVDLGNGIVGHVNQANNMYLFPGIGLGTLLSGAHLITDGMLQAAAEWYDVNLENCFFFINQKPLELALMEVWQDVF

SEQ ID NO: 17941 - protein, 506 aa, Eremothecium gossypii
MTISMIWCGTWARPSKRVSVVTVATVRCCYQYKRTLSQSYESEEARLEALSRCHKTCAEITLHALEKNGGIFIKLGQHIGAMTYLLPQEWTSTMIPLQDKCPQSTLEEIDGMFRHDLRQGLDELFETFDPHPIGVASLAQVHIATLKGSHEKVAVKCQHPHLKEFVPLDVMLTQNVFNVLDVVFPEYPMTWLSDELQSSIYVELDFTKEAENAINTANYFYKYRKETALRIPRVVSAAKRILVLEFVEGERLDNLRYLDTNGISRSEVSSCLSHIFNNMIFTPNVGVHCDPHGGNLAIRVLPKPKAGHNFEIVLYDHGLYRMPTTEMRRDYAKFWLALLDKDTEKMKLYAKKFANVKEEQFPIFAAAITGRSIDTALNYDISTVRSQDEIDRMKNALLSGGLLVDIMALLSTIPRIVLLILKTNDLTRHLDECLENPLGPERTFLILTQYCARTIYQETCERIDHMYRRWTFRWIFCEIKAWLEYERRKSQLIIFDVALWCKKYFV

SEQ ID NO: 17942 - protein, 516 aa, Oryza sativa
  unsure (1)..(516): unsure at all Xaa locations
HREEPRAPFPEDFLGSIGEVGGAASSSSDERHGVRRRWRRPSSRAAAARRLLSSQHRRHCAAPACPWLLGSAPPVLAPSPVAAAAAGDRRGFCSVRRFTGESNAAAAVEEAENGLVAGGDQQAIDFPGGKVSFVAEMNFLPESQRERINCYRVLDDDGRTISGSRFQEVSKELALKMYSEMVTLQVMDTIFFEAQRQGRISFYLTSHGEEAINIASAAALTIDDIVLPQYREPGLLRGRTRGRTRGRTRGRTRGLDYGKGRQMPIHYGSNRLNYFTVSSPIATQLPHAVGAAYSXKMDKKDACAITYFGDGGTSEGDFHAALNFAAVMEAPVIFFCRNNGWAISTPTSEQFRSDGAVIRGQAYGMRSIRVDGNDALAVYSAVHTAREMAIKEGRPILVEALTYRVGHHSTSDDSTKYRPVDEIEHWRTARDPISRYRKWVQGNGWWCDEDESELRNNVRQELLKAIQVAERMPKPPLAELFTDVYDEVPSNLREQERLLRDTIKKHPADYPADVHI

SEQ ID NO: 17943 - protein, 375 aa, Helicobacter pylori 26695
MTFEPYPFERLRALLKEITPKKRGLDLGIGEPQFETPKFIQDALKNHTHSLNIYPKSAFEESLRAAQRGFFKRRFKIELKENELISTLGSREVLFNFPSFVLFDYQNPTIAYPNPFYQIYEGAAKFIKAKSLLMPLTKENDFTPSLNEKELQEVDLVILNSPNNPTGRTLSLEELISWVKLALKHDFILINDECYSEIYENTPPPSLLEACMLAGNEAFKNVLVIHSLSKRSSAPGLRSGFIAGDSRLLEKYKAFRAYLGYTSANAIQKASEAAWLDDRHAEFFRNIYANNLKLARKIFKNTLIYPYSFYVYLPVQNGENFAKTLYQNEGIITLPALYLGRNRIGADYVRLALVYDTPLLEKPLEIIETYRENHA

SEQ ID NO: 17944 - protein, 387 aa, Streptococcus agalactiae 2603V/R
MSENLGQLAINQARENGGKLEVISKVKVEDKRDLSIAYTPGVASVSSAIAEDVELAYELTTKKNTVAVVSDGSAVLGLGDIGPEAAMPVMEGKAALFKRFANVDAVPIVLKTNDTEEIISIVKAISPTFGGINLEDISAPRCFEIEQRLIEECDIPVFHDDQHGTAIVVLAALFNSLKLVKKDIEDIRVVVNGGGSAGLSITRKLLSAGAKHVTVVDRFGIINDKDRESLAPHHKAIAKLTNREFQSGSLEDALENADVFIGVSAPEALHAEWISKMADKPIVFAMANPIPEIYPDQALKAGAYIVGTGRSDFPNQINNVLAFPGIFRGALDARAKTITVEMQIAAARGIASLIPEEELSTTHIIPNAFQNDVADVVAKSVSNAVQK

SEQ ID NO: 17945 - protein, 569 aa, Glycine max
  unsure (1)..(569): unsure at all Xaa locations
MEAERKRLKPRLERRNAMKNIDYQLKDEDADADADAAYLNQRSFRVKGIDGEFDRILRSLGLSGPEDFAIPAAAWEEARAHKARSSVQPREGGIKGVRPPVLEPPLVTSAWTSQQQTERVPPSDSVSRDDHVAVEAQTEEXSGFADDHGSFDIHNLSQMEMGYSESSTGIKGTRPPMLKPPPGARVQVVDDSTCSTWDLLRDLAPQGEEGLPLNRSENESEVAREVERGAVEKEEGEVGTRESPKREEEENVAGLSESCSFSTSNEDDSSSSTTDPTSNNISPQGRIKRIITAESWQKGEFLGGGSFGSVYEGISDDGFFFAVKEVSLLDQGTQGKQSVYQLEQEIALLSQFEHENIVQYYGTEMDQSKLYIFLELVTKGSLRSLYQKYTLRDSQVSSYTRQILHGLKYLHDRNVVHRDIKCANILVDASGSVKLADFGLAKATKLNDVKSMKGTAFWMAPEVVKGKNKGYGLPADIWSLGCTVLEMLTGQLPYCDLESMQALYRIGKGERPRIPDSLSRDAQDFILQCLQVSPNDRATAAQLLNHSFVQRPLSQSSGSSFPHIHGRKG

SEQ ID NO: 17946 - protein, 497 aa, ASPERGILLUS NIDULANS FGSC A4
MTPSLQRQLFYDGKPQHASSGRTFQSINPADATLLAEIPVASQSDIDAAITAAERAFPSWAQTPPIARARILQKAAALLRERNDEIARVETLDSGKAYSETSTVDVVTGADVLEYYANLVGGGGLNGETTQLREEAWVYSKKAPLGVCVGIGAWNYPIQIALWKSAPCLAAGNTMVYKPSEFTSLHGQTLAEIYKEAGLPDGVFNVVYGAGDVGSYLTSHPTVAKVSFTGQVSTGMKVSGAAAGNMKYVTMELGGKSPLLILPDADLENAVDGAMMANFYSTGQVCTNGTRVFIPKSMKKDFESRLVEKMQYIRPGPLFDENTNFGPLSSAVHQEKVTAYIRHGIEQDKATLLYGGLGKPSLPKDLEAGFWVRPTIFTDCTDDMRIVKEEIFGPVMSILTYDSVEEAVKRANTTELGLAAGVFTKDLNLAHRIIDQLEAGITWVNTWGESPAEMAVGGWKKSGLGVENGRRGIEAWVRNKSTLVDMGNAVATVFAKL

SEQ ID NO: 17947 - protein, 487 aa, Ralstonia eutropha
MNAPETIQAKPRKRYDAGVMKYKEMGYWDGDYVPKDTDVLALFRITPQDGVDPVEAAAAVAGESSTATWTVVWTDRLTACDMYRAKAYRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKGGLDFMKDDENINSQPFMHWRDRFLFVMDAVNKASAATGEVKGSYLNVTAGTMEEMYRRAEFAKSLGSVIIMVDLIVGWTCIQSMSNWCRQNDMILHLHRAGHGTYTRQKNHGVSFRVIAKWLRLAGVDHMHTGTAVGKLEGDPLTVQGYYNVCRDAYTQTDLTRGLFFDQDWASLRKVMPVASGGIHAGQMHQLIHLFGDDVVLQFGGGTIGHPQGIQAGATANRVALEAMVLARNEGRDILNEGPEILRDPRRAGAAPLRARARYWGDITFNYTPTDTSDFVPTASVA

SEQ ID NO: 17948 - protein, 144 aa, Glycine max
  unsure (1)..(144): unsure at all Xaa locations
MGSEGSSVVVPRNFRLLEELERGEKGIGDGTVSYGMDDADDIYMQSWTGTIIGPPXRDYPDNPPSVRFQTRINMTCVNQETGVVEPHLFPMLANWKRERTMEDILIQLKREMMSPQNRKLTQPPEGNEESRVDQKGLVVRCCIV

SEQ ID NO: 17949 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 17950 - protein, 657 aa, Bradyrhizobium japonicum USDA 110
MPIDRRAGSVKRRRIKFRDEAFSIHMTASITSTETQEGPVTSGFWALTLGSIGVVFGDIGTSPLYAFHEAVRGAAHGEPVTRVMVLGVLSLILWALLIVVTAKYVLLLLRADNNGEGGTLSLMALGQRALGRRSWFLLALGVVGASMFIGDSMITPAISVLSAVEGLKLATPALEHYVVPLTVLILVLLFAVQSKGTALVASAFGPVMVVWFTCIAVMGAVHIADDPSVLAAINPYYALQFLLSHGTIGLVTLGAVFLAVTGGEALYADLGHFGRKPIQAAWMFFVLPSLLINYFGQGALVLSDPSAIEHSFYRMVPEHLVLPLVGLATAATVIASQAVITGAYSLVYQAVQLGLLPRFEVRYTSESHAGQIYLPRVNRLLLIGVMLLVLLFHTPSNLASAYGIAVSTTMVADGIMGFVVIWKLWNWRAATAAAVILPFVVVDMSFFSANLLKLLEGAWVPLLFGAAMAGTIWTWRRGSGILIQKTRRIEVPLDDLIRSLEKRPPHIVKGTAVFLTSDPSFVPTALLHNLKHNKVLHEHNVVLTIETAHTPRVDLSERFRMEKISDKFSKVRLRFGFMEQPNVPKALAIARKQGWQFDIMSTSFFVSRRSLKASAQSGMPLWQDHLFIALSRSANDATDYFQIPTGRVVEVGTQVTI

SEQ ID NO: 17951 - protein, 144 aa, Yersinia frederiksenii
LMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 17952 - protein, 313 aa, Bacillus anthracis str. Ames
MRNVFCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 17953 - protein, 480 aa, Avena sativa
MVSSEIPSVTTTHTHGPKLFRGMILLPKGPPDVILPENVEFDFNDVFGPVAVHTPTEASIVTPDSPAPLAESGEEVYNDPVVITKRSHSLVGPTLLVSQSLPLSKLTLHESESSSDLLECLSKEKQSNQEALSDEELSNTKENEAVGLDNFEVLKLVGQGAFGKVYQVRMKGTSEIYAMKVMRKDKILEKNHAEYMKAERDILTKVDHPFVVQLRYSFQTKYRLYLVLDFVNGGHLFFQLYQQGLFREELARIYTAEIVSAVAHLHANGIMHRDLKPENILLDARGHAMLTDFGLAKEFDENTRSNSMCGTVEYMAPEIVQGRGHDKAADWWSVGILLFEMLTGKPPFFGGNRDKIQQKIVREKMKLPSYLSSEVHSLLKGLLHKEAGKRLGSGLGGSDEIKNHKWFKAVNWKRLEARQIQPSFCPNVAGQTCIANFDECWTSMPVLDSPVASPVAADSNFVGFSYVRPAPFFQKPSPLG

SEQ ID NO: 17954 - protein, 104 aa, Solanum tuberosum
MAISKALFASLLLSLLLLEQVQSIQTDQVTSNAISEAAYSYKKIDCGGACAARCRLSSRPRLCNRACGTCCARCNCVPPGTSGNTETCPCYASLTTHGNKRKCP

SEQ ID NO: 17955 - protein, 523 aa, Microbulbifer degradans 2-40
MYLQLGDHSMQATKPSGLENIHWGIRYGVCIAFLAAVFVYVLSTVGASNYLLIFAAVTGGYMALNIGANDVANNVGPAVGSGALSLFAAICIAGVCEAAGAIIAGGDVVSTIKKGIIDPSLVTDTREYIWLMAGALLGGALWLNFATWMGAPVSTTHSIVGGVLGAGLAAGGMSIANWPVMGAIVASWVISPVMGGVIAAGTLALIKRLIMYRNDKVTAAKTYVPVLVGVMAWAFSVYLILKGIKKLWKAELYQAVLIGAVIAVVVYLFSRRTVIRQALRMDNSRESVNNLFTIPLIFAAGLLSFAHGANDVANAVGPLAAIVDAFQGGAIHAKAAIPMWVMLIGAIGLAVGLAMFGPKLIRTVGGEITELDKSRAFCIVLAAAVTVIIASRLGLPVSSTHIALGGVFGVGFLREFLKTRYASQLHKIIADRTGAERDKLQAYLDNFHNAPVEEMREMIRKSNVKKLDISIKKKERKQLKKIYRQELVKRQHLYKIIAAWIITVPISGALGALLYFVLRGLSI

SEQ ID NO: 17956 - protein, 175 aa, Aegilops tauschii
MAPTVMASSATSVAPFQGLKSTAGLPVSRRSNGASLGSVSNGGRIRCMQVWPIEGIKKFETLSYLPPLSTEGLLKQVDYLIRSKWVPCLEFRKVGFIFREHNVSPGYYDGRYWTMWKLPMFGCPAPTQVIPEVEEVRKEYPDPYCRIIGFDNMRQVQSVSFIASKPPGCEESGKA

SEQ ID NO: 17957 - protein, 152 aa, Saccharomyces cerevisiae
EFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 17958 - protein, 342 aa, Glycine max
  unsure (1)..(342): unsure at all Xaa locations
PRVRTAARIQSKPTSLLLPQRPQHCVPVLLLRWRQPQTSLASQLYIGLRRPCLKLDSFNSQSFSVFDPNLRLSLSPPTLARALVAMAGTGKFFVGGNWKCNGTKDSIRKLVADLNNAKLEPDVDVXVVAPPFLYIDQVKNSLTERIEISAQNSWVGKGGAFTGEIGPEQLKDLGCKWVVLGHSERRHVIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 17959 - protein, 257 aa, Glycine max
NSGSTHASADAWADAWVLVGPAFTIDVPSSPPRDGGSENRIFLNGSPEKDDGSNFRISGPPKFFAGGESESSSSIGTPDDSDNEEEEVQSQLKIRTGLGSLDAMEDSLPIKRGLSGHFDGKSKSFSDLSQVSNLSNLKELQKQESPFNKRRRVLIASKWSRRSSFYSWSNPQSMPLLPVDEDQDYDYEEEEEDEEENARKVPSASSSSSSSLAEEKKQEDQVQLRFNRMPESYAAHMRLRLGSFKARKLFSCRSART

SEQ ID NO: 17960 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 17961 - protein, 626 aa, Lilium longiflorum
MENSTVSWVVLCLLCWFSIGKAEYLKYKDPSRTVDTRIKDLMKRMTLEEKIGQMTQIERKVASAEVVKDYFIGSLLSGGGSVPAPNASAQQWVDMVNEFQKGALATRLGIPMIYGIDAVHGHNNVYNATIFPHNVGLGATRDPDLVKRIGAATALEVRATGIPYVFAPCIAVCRDPRWGRCYESYSEDHTVVQAMIEIIPGLQGDVPAKHKKGNPYVGGKDKVAACSKHFVGDGGTHDGINENNTIISAKGLFSIHMPAYYNSIDKGVSTVMISYSSWNGKKMHANHELITGFLKKKLKFRGFVISDWEGIDRITSPPGANYTYSVQASISAGLDMIMVPNNYQDFIGNLTYLVKKNVIPMSRINDAVRRILRVKFVAGLFENPLADYSLADQLGNKEHRELAREAVRKSLVLLKNGKSINQPLLPLPKKAPKILVAGSHAHDIGLQCGGWTMEWQGKIGNITVGTTILDGIKATVDPTTNVIYEENPDATFVENNNFSYAIVVVGEIPYAETAGDNLNLTLPAPGPSMIKDVCGAVKCVVVIVSGRPLVIEPFLGSMDAVVAAWLPGSEGQGVSDVLFGDYGFTGKLPRTWFKSVDQLPMNVGDKHYDPLFPFGFGLTTGPVSQI

SEQ ID NO: 17962 - protein, 596 aa, Novosphingobium aromaticivorans
MASTDAVGRGGQLPGREGLMEPHPGIPFLREALVLLAAAGLAVPLLNRIRVNPILGYLLIGGVIGPYGLGLLAADYPFLSHAVISDIAGVRGLAEIGVVFLLFMIGLELSLERLWSGRALVFGMGSLQILLTAGLIAWIATGLGVEEPTALIVGAALSLSSTAIVMQLLIHGRRQFSAVGKTGFAILLMQDLAVVPILFMVGVIATPGSGGLAAGLAGALGKATLAIVLIYLAGRLLLRPVLRQVAQTRSPEMFTAAVLLTVIGVSALTARFGLSMALGAFLAGLLLAETEYRHQIEVDIEPFKGLLLGLFFMSVGMGIDWRQVLASPLEIAGMVTGLWLLKAVVITGLAIAFGRPRHVAAEAGMLLGQGGEFAFVIVGVAAGLGVVGGVLEQQILIVTGISMLLTPVVAHLARQLSAAMERKRLAAAADTDESFADCEGHIIIAGFGRVGQTLARALDAENVAFVALDADAAMTAGLKDRHLPVFYGDASRSEILAKAGIDHAAAVVVTMNDPEAASRIVHQIHQRWPSMPIHARARDPEHARRLLELGASFCTPETVEASLQLAANVLVGAGVDAEVTRRRITEQRAYETGDSP

SEQ ID NO: 17963 - protein, 506 aa, Ruta graveolens
MDLLLLEKALLGLFAAAVVAIAVSKLRGKRFKLPPGPLGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 17964 - protein, 479 aa, Zea mays
  unsure (1)..(479): unsure at all Xaa locations
MAGGGAAYQSSSASPDWLNKGDNAWQMTSATLVGLQSMPGLVILYGSIVKKKWAINSAFMALYAFAAVWLCWVVWAYNMSFGDRLLPFWGKARPALGQRFLVAQSQLTATAVRYRDGSLEAEMLHPFYPAATMVYFQCVFASITVIILAGSLLGRMDIKAWMAFVPLWITFSYTVSAFSLWGGGFLFQWGVIDYSGGYVIHLSSGIAGLTAAYWVGPRSALDRERFPPNNILLVLAGAGLLWLGWTGFNGGDPYSANIDSSMAVLNTHICASTSLLMWTLLDVFFFGKPSVIGAVQGMITGLVCITPGAGLVQGWAAIVMGILSGSIPWYTMMVXHKKWSFMQRIDDTLGVFHTHAVAGLLXGGAITGLFAEPVXCNLFLAIPDSRGAFYGGDGGSQFGKQIAGALFVIGWNIVITSIICVLIGLVLPLRIPDAQLLIGDDAVHGEEAYAIWAEGELNDVTRQDESRHGSVAVGVTQNV

SEQ ID NO: 17965 - protein, 357 aa, Lactobacillus gasseri
MSEVVAATEYLKFWWPKVNVFWSGIIIILFLVLANLASAKAYASLEFWFAMIKVVTIILMIILGFIVIFFGVGNGGKPTGFSNLWSHGGFFTGGVKGFFFSMSIIVGSYEGIELLGISAGEVANPQEAIVKSVKSVLWRILIFYVGAIFVIVTIYPWNELSSIGSPFVTTFAKVGITAAASIINFVVLTAALSGANSGIYSSSRMLFKLAHDGDAPKTFGHISKRIVPNHAILGISGGILIGFVVNMIAATINKSTQDLFVIVFSSSVLPGMIPWFVILLAELKFRHNNQELLVDHPFKLPLYPISNYFAFLMLIVIVVFMLINPETRVSVLVGAAVLIIATIVYLIRHRKDGVDGK

SEQ ID NO: 17966 - protein, 286 aa, Glycine max
  unsure (1)..(286): unsure at all Xaa locations
MMKGKVKSSKLKLGVPTLFILCALFFFVGFFVSPLLFQDLDDVGPRSRILQESVKKEYEPLEHGESGEPFVDSIPSQILSWRPRAVFFPNFTSVEVCQQIIEMAKPKLEPSKLALRKGETAESTKDTRTSSGTFISASEDKSGILDLVERKIAKVTMIPRTHGEIFNILKYEVGQKYDSHYDAFNPDEYXXVESQRIASFLLYLSNVEAGGETMFPYEGGLNIDRGYDYQKCIGLKVKPRQGDGLLFYSLLPNGKIDKTSLHGSCPVIKGEKWVATKWIDDREQHY

SEQ ID NO: 17967 - protein, 478 aa, Salmonella typhimurium LT2
MSQRSKYNSAYVYVLCCIAALAGLMFGYSTAVITGVVLPLQQYYQLTPTETGWAVSSIVIGCIIGALVGGKIADKLGRKPALLIIAIIFIASSLGAAMSESFMIFSLSRIVCGFAVGMAGTASTMYMSELAPAEIRGKALGIYNISVVSGQVIVFIVNYLIAKGMPADVLVSQGWKTMLFAQVVPSIAMLAITLFLPESPAWCARNNRSEARSIKVLTRIYSGLTATDVAAIFDSMKETVRSQDNVAGGERTNLKSSPVLRYILLVGCCIAVLQQFTGVNVMNYYAPLVLQNSSTEVVMFQTIFIAVCNVVGSFIGMILFDRYGRIPIMKIGTIGSIVGLLIASYGLYTHDTGYITIFGILFFMLLFAVSWSVGAWVLISEVFPEKIKGFGMGLAVSLMWIANFLISLLFPVINDNAWLQETFGGAFSMWIFVVFNLVCYVFISRYVPETKGVPLTEIERLAENKLREIQGKRRDVIA

SEQ ID NO: 17968 - protein, 297 aa, Shigella flexneri
MTNLKAVIPVAGLGMHMLPATKAIPKEMLPTADKPMIQYIVDEIVAAGIKEILLVTHASKNAVENHFDTSYELESLLEQRVKRQLLAEVQSICPPGVIIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGSKFRKGIEKLLSE

SEQ ID NO: 17969 - protein, 629 aa, ASPERGILLUS NIDULANS FGSC A4
MDAKPQRIRVRGDENAPFPLAATKTLHQRTKSTTALSATFQNGASKNGARRAAFGDVSNTASLVHGNRDDASLAGRKPSKLLEKGSMATEKKSTALSQPAQRPVSMSGFKGLLNNVTNPKPLEVTKQAAGQQQSTNSRKTLNKRATVFKDHLEPLTESKELTSKESKPEPKEGNMKGHSKPSLGEHLQKDGKVEGTVSLNEKLESEMCKLEVLLSQPGAEEDEKEFPDLEDDDCKVQPMPKQTGEAHIAADSNGPAISSRVTCKSTTVSRASQDDLPHQSEPEEYWDDDDEENEEDDYITARSYRSRSENTTGGATTLLFPRYNQQVKRELALAKQIVEATRTVEDIEDDYCDTSMVAEYSEEIFEYIREQEIKMLPNAHYMDNQAEIQWSMRSVLMDWLVQVHHRFSLLPETLFLCVNYIDRFLSCKIVSLGKLQLVGATAIFIAAKYEEINCPSVQEIVYMVDGGYTVDEILKAERFMLSMLQFELGFPGPMSFLRRISKADDYDLETRTLAKYFLEVTIMDERFVGSPASFLAAGAHCLARLMLKKGTWSPAHVHYAGYTYSQLYPLVSLIVECCEMPRKHHSAIYDKYNDRRFKLASAYVEAEMRKNFRLPEPAIDRKTTLGQGH

SEQ ID NO: 17970 - protein, 84 aa, Hordeum vulgare subsp. vulgare
DDVGIPLNYRHMDGFGVNTYTLISRDGKAHLVKFHWKPTCGVKCLLDDEAVTVGGTCHTHATKDLTDSIAAGNYPEWKLFIQTI

SEQ ID NO: 17971 - protein, 318 aa, Oryza sativa
  unsure (1)..(318): unsure at all Xaa locations
APSPSPPASDLEVGFAKLQGEDFEYYMQTYSIVLGRHSRRSDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGDNTNDCFWFQVKXKKVNGHGFECVVMQNKKKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 17972 - protein, 162 aa, Zea mays
  unsure (1)..(162): unsure at all Xaa locations
MAVTIAWVXARQTFDSRGNPTAEGDVGLRDSGYARGAGPRGASTAIYEALKLRNAGSDYLAKGALKGASMGNNIMGPIFVANPPTEQVEIDDFMGHQVDGTSNEXGWWEQNFGPNDILAVSLAGXELGAMVKKIPLDQNIEGLGGXNETLGVPVPAFKVIKE

SEQ ID NO: 17973 - protein, 138 aa, Oryza sativa
MQGGGGVSCAVAGDAPSSTRGGGGGGMLGLTLFDPPGGEQPAERIGRLVRESPVVIFARRGCCMCHVMRRLLAAVGAHATVIELDEAAEEAAASAAAAAAVPALFVGGAPVGGLDGLMGLHLSGRLVPRLREVGALCG

SEQ ID NO: 17974 - protein, 462 aa, Ralstonia metallidurans
MHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKAGSAMPAASAQIQ

SEQ ID NO: 17975 - protein, 396 aa, Helianthus annuus
MALRMSPVTLQREIYPSYTFHQSKNLRSPKFAMASTIGSSTPKVESTKKPFTPPREVHLQVTHSMPPQKIEIFKSIEGWAEDNILVHLKPVEKCWQPQDFLPEPASDGFEEQVKELRARAKEIPDEYFVVLVGDMITEEALPTYQTMLNTLDGVRDETGASPTPWAIWTRAWTAEENRHGDLLHQYLYLSGRVDMRQIQKTIQYLIGSGMDPRTENSPYLGFIYTSFQERATFISHGNTARHAKDYGDLKLAQICGTIAADEKRHETAYTKIAEKLFEIDPDGTVLAFADMMRKKISMPAHLMYDGRDDDLFDHFSAVAQRLGVYTAKDYADILEFLVGRWKVADLTGLSGEGRKAQDYVCGLPSRIRRLEERAAARAKEGPSIPFSWIFDREVKL

SEQ ID NO: 17976 - protein, 484 aa, Proteus mirabilis
  unsure (1)..(484): unsure at all Xaa locations
MEKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGYGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 17977 - protein, 317 aa, Escherichia coli O157:H7 EDL933
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 17978 - protein, 886 aa, Emericella nidulans
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 17979 - protein, 511 aa, Nepeta racemosa
ILIALLCTLPFLFFLKKWRRSYSGKTPPPSPPKLPVLGNLHQLGTFPHRSLQSLSRRYGPVMQLHFGSVPVLVASSPEAAREIMKNQDLNFSNRPNLSIPRRLLYDNHDVAFAPYGEYWRQIRSICVLQLLSNKRVQSFRRVREEETSIMVEKIMQLQKTTPTAAVNLTDLLTCLTNDVFCRIALGKKYGGTTTGDGEYHVRSLKKNLAEFYVLLGISPLWEYIPWLEWTRRFDGVDRRIEEVSRTFDEFLGKVIQEHRVRDKREDTTVVGDTVGLDFVDLLLQFQRENERSSSPVDDLTIKAVILDMFLAGTDTTVTALEWALSELIKNPRAMKILQKEVRGVAGSKGEIEESDLEKMPYLKAVMKESLRLHAPVPLLVPRESTRDTKVLGYDVASGTRVLINCWAIGRDSSVWEESETFLPERFLETSIDYRGMHFELIPFGSGRRGCPGATFAAAIDELALATLVHKFDFKLPNGVRVEDLDMSEGSGFTIHKKFPLLVVPTPHACTS

SEQ ID NO: 17980 - protein, 254 aa, Glycine max
  unsure (1)..(254): unsure at all Xaa locations
MSRRYDSRTTIFSPEGRLYQVEYAMEAIGNAGTAIGILSKDGVVLVGEKKVTSKLLQTSTSTEKMYKIDDHVACAXVAGIMSDANILINTAXRVQAQRYTYAYQEPMPVEQLVQSLCDTKQGYTQFGGSSVHLESSFLFAGWDKNFGFQLYTSDPSGNYGGWKAAAYXVPNNQAAQSILKQDYKDDITREEAVQLALKVLSKTMDSTSLTSEKLELAEVFLSPSGKVKYQVCSPENLTKLLVKFGVTQPATDTA

SEQ ID NO: 17981 - protein, 414 aa, Leptosphaeria maculans
MDNELDNLISLLQKSKASLKEKHGDRIRSIFAAHHSGSILPKEDKSLYDKCLATVDLLDEVQQMLTPPLHTLIDGFFGFINSKTLLCAVEFGIPDALSQGPKSIEQLASSSPQGELSPHRLTQVLRTLTGIGIFNYDKTSKLYSNNATSDLITTAHWSKWVYWTKFYPTEFYDMMRFLPDHIKANASRTAAQSNYNTDMEFYEYLSNSGLAKEFHRVLGAGATAQLPGMISDFPWDTLGDETVLDLGTGSGEFLFQLLENYPRMRGAFMDIPSTISRIQAECEQPGGRFSGVRDRVAGFHAGNFLDEVPASVVYTIKWCLHNWSDEDTIKILQNIRRAIVVKPEARLLIIESVLEDGRTGRPARYGDIIMMATCNGKERDIENWQAVCEQSGWEVVKSWALRNSIPSCLELRPI

SEQ ID NO: 17982 - protein, 481 aa, Neurospora crassa
MSSGPVETYEGVAGVANNGGNPLLEDLNRYYSAGDFGWIMTCTALVLLMVPGVGFFYSGLARRKSALALIWLSLMSIAIVGFQWFFWGYSLAFSHTGSAYIGNLSNFGLMKTLAQPSVGSGKIPDLLFCLYQGMFAAITPALAIGACADRGRMLPALVFMFIWTTIVYDPIAYWTWNGNGWSFKMGGLDFAGGTPVHISSGAAALAYSLMLGKRNGYNKVNGLPYRPHNVTHVVLGTVFLWVGWFGFNGGSALAANLRAVMACIVTHIAACVGGLTWVLLDYRLERKWSTVGFCSGAIAGLVAITPAAGYVPPWSAFIFGVVGGISCNFATKLKFLLGIDEALDVFAEHGVGGIVGNLLTGIFAADYIAALDGVSIGDSAIAGGWVNHHYIQLAYQLADSVAGFSYSFVMTCVILFLLNLVPGLSLRVDHHQEDIGLDDDQLGEFAYDYVEVTRSLDVIPGLTAPNSTAGSISGRDPEKQV

SEQ ID NO: 17983 - protein, 429 aa, Pseudomonas putida KT2440
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 17984 - protein, 197 aa, Brassica oleracea var. capitata
MGRKKLEIKRIENKSSRQVTFSKRRSGLVEKARQLSVLCDASIALLVVSSSGKLYSFSAGDNLVRILDRYGKQHADDLKALDLQSKALSYGSHNELLELVDSKLVESNVGGVSVDTLVQLEGVLENALSLTRARKTELMLKLVDSLKEKEKLLKEENQALASQKEKKNLAGAEADNMEMSPGQISDINLPVTLPLLN

SEQ ID NO: 17985 - protein, 158 aa, Escherichia coli O157:H7 EDL933
MKLISNDLRDGDKLPHRHVFNGMGYDGDNISPHLAWDDVPAGTKSFVVTCYDPDAPTGSGWWHWVVVNLPADTRVLPQGFGSGLVAMPDGVLQTRTDFGKTGYDGAAPPKGETHRYIFTVHALDVERIDVDEGASGAMVGFNVHFHSLASASITAMFS

SEQ ID NO: 17986 - protein, 236 aa, Rhodobacter sphaeroides
MSFDRRIKIAPSILSADFANFGAECRAIEAQGCDWVHVDVMDGHFVPNLTFGPAMCAAIRPHIKGVMDVHLMIAPVDPYIEAFAAAGADVITAHLEAGPHIHRTLQAIRGTGRKAGLALNPGTGLDAVGHLLDLLDLVCIMTVNPGFGGQKFIASQVDKVRDLRAMIGDRPIHIEIDGGVTPETAPLVAAAGADVLVAGSAVFKGGSVDNPEPYGANIRAIRAAAEASLGRAFAAK

SEQ ID NO: 17987 - protein, 284 aa, Oryza sativa
MSRFCCFGAGCSEFSGHASTSSGKGKGIQGQVKVSYGFYLVRGMTNHPMEDYHVAELAEEKGNELGLFAIFDGHLGDTVPAYLQKNLFANILNEEEFLTQPDRAIIKAYEKTDQAILSHTPDLGQGGSTAVTAILLNGRKLWVANVGDSRAVLLKGGRPIQMSTDHDPNVERSAIENRGGFVSNMPGDVPRVCGQLAVSRAFGDRNLKSLLKSEPDIKVEDIDYTAELLVLASDGLWKVMNNQEVVDVAKRFKDPQAAAKQLTAEALKRDSKDDISCVVVRFRM

SEQ ID NO: 17988 - protein, 339 aa, Salmonella typhimurium LT2
MTIIKSYAAKEAGGELELYEYDAGELQPEDVEVRVDYCGICHSDLSMIDNEWGFSQYPLVAGHEVIGRVAALGSAAQDKGLKVGQRVGIGWTARSCGHCDACISGNQINCQEGAVPTILNRGGFAEKLRAGWQWVIPLPENIDMASAGPLLCGGITVFKPLLMHHITATSRVGVIGIGGLGHIAIKLLHAMGCEVTAFSSNPSKEQEVLAMGANNVVNSRDPEALKALAGQFDLIINTVNVDLDWQPYFEALTYGGNFHTVGAVLKPLPVPAFTLIAGDRSISGSATGTPYELRKLMKFAGRSKVAPTTELFAMSQINEAIQHVRDGKARYRVVLKADF

SEQ ID NO: 17989 - protein, 154 aa, Xanthomonas axonopodis pv. citri str. 306
MSQFDLTPPSPAQRDALIAGLSDEEQRVLLHHGTEAPFCGVFLDNKLDGVYTCRLCGLPLFRSSAKFESGTGWPSFFAPYDPAHVREIRDTSYGMIRTEIVCARCDSHLGHVFPDGPPPTGERHCLNSVSLGFTENGQALPNPLHRRGAEAQAA

SEQ ID NO: 17990 - protein, 459 aa, GIBBERELLA ZEAE PH-1
MSDSEQKHAIDSVNVEAQLQASLKARWNRSPLYNATILGLCSFAAPGLWSAMNSLGAGGAQKPYLVNTGNALTFCLMIISCWFTSGIVKYIGIKGALIIGTVGFAPYSAGLYLNNRYGVEWLVIFGAACCGVSAGIFWSAEAAIAIGYPEPRNRGRMVAYWLSFTRFSQVMGGAINLGLNVNQNEAGKVSYKVYLIFIALQALAPFIACLLNKPSQVQRSDGRQVDMSIHDHPWKEFKATTRTFLKKDFILLILWIGQGVYSESVFFTYIALWFSVRARALASFISGIVAVIISNLLGVWLDQHQISLKKRARWAYIVIMTLQGGWWIWLAINVTKFNRQGALYDWADPGFGAAFGVFVFLVTGFQLNYNFAFFVIGEISTSSQETVRLSALLRATESAWQALSYGLNALPIMATVGSTYTNFGLWAIAIFPAWLVIRGLGESERQDVGLETADTSEND

SEQ ID NO: 17991 - protein, 299 aa, Bacteroides fragilis
GRMVFRAAVKNFGNDIQIVGINDLLDAEYLAYMLKYDSVHGRFEGEVAVEDGALIVNGNKIRLTAEMDPANLKWNEVDADVVVESTGFFLTNETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVS

SEQ ID NO: 17992 - protein, 342 aa, Pseudomonas aeruginosa PAO1
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEVLQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 17993 - protein, 507 aa, Oceanobacillus iheyensis HTE831
MSGNQEVDVLSGKHEELANKLDDIKLYINGEFMDAEDRGTFDNISPFSNEKINSVASGQAADIDKAVQSAKKAFKGEWGNLKQVERLEYVYKIGDLIEQHTDEIAILESLDTGLPISQTRKQVSRSANNFRFYADTVKSQMYGEVYQVDDEFINYTVRSAVGVAGLITPWNAPFMLETWKIAPALATGNTVILKPAEWSPLTANRMAEIIDQAGLPDGVFNIVHGFGETAGDALVKHPDVQLISFTGETTTGSTIMRNGADALKRFSMELGGKSPIIVFEDADLERALDAATWGIFSFNGERCTANSRLYLHESIADEFIEKLKQRVWNIRVGDPLENNTQIGPLIKTEHYNNVKKYLKIAEEEGCEIISGVIPKELNRGNYVAPTILLNASNEMRVVQEEIFGPVIAVMTFNDETEVIEKANDVRYGLAGYVWTNDMKRGHRVAHAIDSGMLWVNSQNVRDLRTPFGGSKDSGIGREGGHYAFEFYTEQKIIHVAIGDHHIPQFGK

SEQ ID NO: 17994 - protein, 456 aa, Betaphycus philippinensis
  unsure (1)..(456): unsure at all Xaa locations
PEYVVKDTDXLALFRVSPQPGVDPIEASAAVAGESSTATWTVVWTDLLTACDLYRAKAYKVDAVPNTSDQYFAFIAYDLDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTA

SEQ ID NO: 17995 - protein, 382 aa, Oryza sativa; identical to SEQ ID NO: 12630

SEQ ID NO: 17996 - protein, 127 aa, Anaplasma phagocytophilum
MSRSRPLSPHLSVYKLPITAWLSITHRITGVLLLMGLTLFTWLLISLHWTSGQLWGLLDSWIGVLLVKVIIGGCIAALCYHYYNGIRHLFWDCGIGFGKSEATFSGWLMLGFAVTSLIGLGFIGFFS

SEQ ID NO: 17997 - protein, 759 aa, Oryza sativa (japonica cultivar-group)
MWRLRVAEGGGDPWLRTKNGHVGRQVWEFDPAAGDPDELAAVEAARRGFAARRHELKHSSDLLMRMQFAKANPLKLDIPAIKLEEHEAVTGEAVLSSLKRAIARYSTFQAHDGHWPGDYGGPMFLMPGLIITLYVSGALNTALSSEHQKEIRRYLYNHQNEDGGWGLHIEGHSTMFGSALTYVSLRLLGEGPDSGDGAMEKGRKWILDHGGATYITSWGKFWLSVLGVFDWSGNNPVPPEIWLLPYFLPIHPGRMWCHCRMVYLPMCYIYGKRFVGPVTPIILELRKELYEVPYNEVDWDKARNLCAKEDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHGWPISDCTAEGLKAALLLSKISPDIVGEAVEVNRLYDSVNCLMSYMNDNGGFATYELTRSYAWLELINPAETFGDIVIDYPYVECTSAAIQALTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVYTNLEGKRPHAVNTGWAMLALIDAGQAERDPIPLHRAAKVLINLQSEDGEFPQQEIIGVFNKNCMISYSEYRNIFPIWALGEYRRRVLAADK

SEQ ID NO: 17998 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEQNALEGMLDTL

SEQ ID NO: 17999 - protein, 249 aa, Zea mays; identical to SEQ ID NO: 2479

SEQ ID NO: 18000 - protein, 766 aa, Arabidopsis thaliana
MWRLRIGAKAGNDTHLFTTNNYVGRQIWEFDANAGSPQELAEVEEARRNFSNNRSHYKASADLLWRMQFLREKGFEQKIPRVRVEDAAKIRYEDAKTALKRGLHYFTALQADDGHWPADNSGPNFFIAPLVICLYITGHLEKIFTVEHRIELIRYMYNHQNEDGGWGLHVESPSIMFCTVINYICLRIVGVEAGHDDDQGSTCTKARKWILDHGGATYTPLIGKACLSVLGVYDWSGCKPMPPEFWFLPSSFPINGGTLWIYLRDIFMGLSYLYGKKFVATPTPLILQLQEELYPEPYTKINWRLTRNRCAKEDLCYPSSFLQDLFWKGVHIFSESILNRWPFNKLIRQAALRTTMKLLHYQDEANRYITGGSVPKAFHMLACWVEDPEGEYFKKHLARVSDFIWIGEDGLKIQSFGSQLWDTVMSLHFLLDGVEDDVDDEIRSTLVKGYDYLKKSQVTENPPSDHIKMFRHISKGGWTFSDKDQGWPVSDCTAESLKCCLLFERMPSEFVGQKMDVEKLFDAVDFLLYLQSDNGGITAWEPADGKTWLEWFSPVEFVQDTVIEHEYVECTGSAIVALTQFSKQFPEFRKKEVERFITNGVKYIEDLQMKDGSWCGNWGVCFIYGTLFAVRGLVAAGKTFHNCEPIRRAVRFLLDTQNQEGGWGESYLSCLRKKYTPLAGNKTNIVSTGQALMVLIMGGQMERDPLPVHRAAKVVINLQLDNGDFPQQEVMGVFNMNVLLHYPTYRNIYSLWALTLYTQALRRLQP

SEQ ID NO: 18001 - protein, 353 aa, Zea mays
  unsure (1)..(353): unsure at all Xaa locations
MAPLGDGGSCCRGGRPTTWWVSFGXEMLIDFVPDVAALSLAESGGFVKAPGGAPANVACAIAKLGGSSAFVGKFGDDEFGHMLVNILKQNNVXNSEGCLFDKHARTALXAFVTLKHDGERGXVCYRNPSADMLLTEXAELVLGLVRXPPGVFHYGSISLISEPCRSAHMAAMRAAQGPRGVLCSXYDPQRAASPLWPXSPDAAREGIXLSIWKEADFIKVSDDEVAFLTRGDANDEKNVLSAVGLTGLKLLVVTDGDKGCRXLHPRTSKGSVPRLQGSTPVDTHPGAGDXRFVGSLLVNVAKDDSIFHNEEKLPRXALKFSNACGAICTTXKKGAIPALPTVATAQDLIAKAN

SEQ ID NO: 18002 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 18003 - protein, 670 aa, GIBBERELLA ZEAE PH-1
MVHHRHHHESAVPGVIPVPHGPVDSDSEQISNEPIAYATADERRIFSHVTRPDDSYNEDGIYWADLPLAQRYRFVSKVDNEAAKEEAATAWSMFKEDPLSPLSWYFRHAVIPGAGLGLEGYVLFSIGNLEPLFKAVWPECWGKEPTTCSHNWVASVTYLEIIGIMVGQAVVGVMGDWVGRRWGLIQDAAIMFIGLLMLTASWGLTLQGWVICYAWSLFFYGFGVGGEYPITATSSLEGVSSGGRVSTREDRLHRGRRVTTAFLMQGWGQFVNQVILIALLAIFNNGKSSPPYSASAAQYTFRLSFAFPAIGTLWLLYYRTYRMRSAGKQLAEAKKRSNVTGYDLNALRHCFGSFGGRLLATSGTWFCNDVFFYGNKLFQGQFIKVISPDSNSIFTTWTWNLVNITVSLAGYYLASLLIDNKMYGRKMMQQVGFFMCFLMFVIPAFRYEYYTSPAGIHSFQAMYFISSFFNQFGPNSVTFLVAGEVFPTPVRATAHGFSACIGKSGALLASVLYNYIDDQTKFYVVPWFGLVGMLLTWVFLPDTTGLDLKEQERRWHYIRDGKESEYHGVAVNPIHLSLWERLRGLGKSYDPEADWRAKVQDMRAEWELVQANRGPKETEGAMPEDGEFSPEIHEFFKRSSPKHIGRRDESLMVDSVNEKTAAPSDDSITK

SEQ ID NO: 18004 - protein, 632 aa, Glycine max
RRNLRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPQQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAMASGAGANFINISMSSITSKWFGEGEKYVKAVFSLASKIAPSVIFVDEVDSMLGRRENPGEHEAMRKMKNEFMVNWDGLRTKDTERVLVLAATNRPFDLDEAVIRRLPRRLMVNLPDAPNRAKILKVILAKEDLSSDIDMDAIASMTDGYSGSDLKNLCVTAAHRPIKEILEKEKKEQAAAVSEGRPAPALSGSADIRSLNMEDFKYAHQQVCASVSSESINMTELQQWNELYGEGGSRVKKALSYFM

SEQ ID NO: 18005 - protein, 353 aa, Synechococcus sp. PCC 7942
MSKIRVGINGFGRIGRLCLRAGFDDPQLDFVAINDLVPAKNLAYLLHYDSTHGRLQQTVRAEEDRICAGDRCIQCFSETDPAAIPWGELGVDVVIEATGRFTDYAAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNEWGYSNRMLDLIRYMRSVEQQPAWAPRSLTPA

SEQ ID NO: 18006 - protein, 345 aa, Cytophaga hutchinsonii
MFKRLILSLLILSSIHVYAQEKPYLGAEIRTIETFLYGKFEVRMKPAEASGIIYSFFTFYDEADFATSWNEIDIEVLGRYSNEVQFNAITGNHLMSEKRYVLPFNPHENFHDYAFTWTPQYIAWSVDGAEVYRLTGNAAVKMNHPQKLMMNIWPSSAVGWAGKIDVTKFPLEAGYDYVKYYTYQPASKDTFKLKWTDNFDKLDYGRWQLATHTFDTNECVFTPDNAVVEEGILKLKLTKPVDEEIVPLPTQFIESATCIPNRSKKYAMYIPVKVKFYAPMSRVYYNPEFFTVSEGVVKHVYFDVDRTYVILYVDGLDIRKIKTQKVFYKPASSDAEKFIQDVIIK

SEQ ID NO: 18007 - protein, 464 aa, Gelidiella acerosa
KMGYWDPDYQVKETDVLALFRVSPQPGVDPVEASAAVAGESSTATWTVVWTDLLTACDLYRAKAYKVVEVPNTTDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEIKGHYMNVTAATMEDMYERAEFAKQLGTIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALEAMVIARNEGKDYVAEGPQILRDAAKTCGPLQTALDLWKDITFNYTSTDTADYVETPTANV

SEQ ID NO: 18008 - protein, 578 aa, Oenococcus oeni MCW
MTSKKGSDLLVSVLTDWGIKEVYGLPGDSVDTTVDALRRQKDKIKFIQVRHEEVASLAASASAKYTGKIGVCLSIGGPGAIHLLNGLYDAKMDHVPVLALLGQVTSQSLNEGYFQEVNTPKLFDDVAVFNRTISSVDNLAEIVDQAIRSAYENKGVAVLTIPDDIPDQELKTIYHSSAKAFSLAKPSINEEQINKASELIKNSQKPIALIGLGAKESGEEVTSFLEKNNIPFVQTLPAKGTISDDHPNSLGNVGKLGTKPAYEAMKNADLLILLGSNYPYLPYLPNKGQAKCIQVDLKAENLGKRYSVTTAIQADVYDVVHALNKKGVLRDNKSFLQACQKNMDNWNKWMQEKRELDTTPISPESMVAYIDQTAPDDLVYSIDVGTSTSWAARFLHVKRNQKFAISAWLGTMGCGLPGAIAGQIVFPKRRVLSLIGDGAFSMVMQDFVTAVKYKLPIIFVIINNQKLAFIEYEQQSAGQLNYEINLADIDFGKFAQAAGGIGITVKSNDKFKEALDQAYQTKDKPVLINAYVEDNAPLPGKIVLDEAKGFAKFGQEYLENYWKIPELPPFKDILRQFF

SEQ ID NO: 18009 - protein, 283 aa, Zea mays
  unsure (1)..(283): unsure at all Xaa locations
AYTVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNSLEWNLTVPTVYMFLVRFLKAAALGNKVEKEMENMVFFFAELALMQYGLVTRLPSLVAASVVYAARLTLKRAPLWTDTLKHHTGFRESEAELIECTXRCWSAHTRRPXADSKLRAVYKKYSSEQFGGVALRPPAAAVEMK

SEQ ID NO: 18010 - protein, 604 aa, Eremothecium gossypii
MAKQAGTPDDDVEDIEKSFYVSGKEQARVSTDLAVDEPISVQPEPRKGWNGFVDTFRRAEMPVIDPNLSEAEKLAIRTAAAPLSRRLKNRHLQMIAIGGAIGVGLFVGSGKALATAGPAGVLIGWGLTATMILIMCLSLGELAVTFPVSGGYITYAARFIDESWGFANNFNYMMQAMVVMPLEIVAASVTVGYWDTDPKYKLAFVALFWVVIVSINLFGVRGFGEAESIFSLIKVITIIGFIIMGVVLISGGGPDHEVIGGKYWNDPGPFVGNAPSDKFKGVCSVFVTAAFSFAGSELIGLAAAETREPRKSIPKAAKQVFWRITLFYILSLLIVGLLVPSNNEHLLAPQQIDAAHSPFVIAMDMHRIRVLPSIINVVILTAVISVGNSSVYSSSRTMCALAEHGFLPKIFGYIDRKGRPLFAICFTSLFGLLCFVAGAKEEGEIFDWLLAISGLSSFFTWLTINLAHMRFRMALKAQGRTTNELSFTSPTGFIGSCYAVGLICVVLVAQFWVALYPPSPDGTSAKPSPILFFKQYLSFAVAIVMYLAHKIWSRNWKFFIKAKEMDIDTGRRELDLELFKEELAQERALLAQKPFIIRVFNFWC

SEQ ID NO: 18011 - protein, 204 aa, Triticum aestivum
MGNPEKLMAQIFDLKFTSKSLQRQARKCEKEEKEQKLKVKKAIEKGNVDGARIYAENAIRKRTEHMNYLRLASRLDAVVARLDTQAKMQAIGKSMGSIVKSLDSSLATGNLQKMSETMDSFERQFVNMEVQAEFMEGAMAGSTSLSTPETEVNSLMQQVADDYGLEVSVGLPQAAAHAIPAAKDKEKVDEDDLTRRLAELKARG

SEQ ID NO: 18012 - protein, 99 aa, Zea mays
MSGAGEEDKKSAEGGAHISLKDKAQDDNEVLFRIKRSTQLNKLMNAYCDRQSVDMNAVAFLFDGRTLRDEHTPDDLQMEDGHEIDAMLHQTEGSGPGTT

SEQ ID NO: 18013 - protein, 488 aa, Chordaria chordaeformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNGGRDYVGEGPEILRRAATTCGPLKAALDLWKDITFDYTSTDTPDFVEVATESR

SEQ ID NO: 18014 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKNCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNAL

SEQ ID NO: 18015 - protein, 617 aa, Bradyrhizobium japonicum USDA 110
MTMGALGVVYGDIGTSPLYALKEAAKAAAHGATVTPDAVLGVASLILWALLLIISLKYALLILRADNRGEGGIVALLALLHARNAQPGTWRSHLLVVGLVGAALLYGDGAITPAISVLSAIEGLKVDAPSLAPAVVPVTVVILVGLFMMQKQGTGFIGRIFGPVMLAWFAVLAALGIHGIVKAPAVLAALSPLYAVEFLIHQDFHVSFAILGAAFLAVTGGEAMYADMGHFGRLPIRLAWFAICLPALVLNYFGQAALLITDPAMIENPFFQLCPDALHYPLVAFSAVATVIASQAIISGVFSLTQQSIQLGFLPRMQIRHTTSDAIGQIYVPLVNWLLAAATLGAVLSFGSSDALAGAYGIAVSLLMAITTLLAALVAIQWGYSPWLVVAVNGAFFVIDVIFFSANSIKLFEGGWFPLLLAALVAFMMLTWRSGVKLVEAARAKLRQPEEDLIETAVNKCSARLPGTAVFLASAPRGVPLALTQFVKHNRVLHERVLLVTVLIEESPHIPDEERAEVIEIIPGITRVILHYGFMQNPTIFDGLTLTCRQGKLPGIDLSDITYYVGRETIIPREDVPGMWVWREGLFAFLQRNAERSAAFFGVPTKQVVEFGTELEI

SEQ ID NO: 18016 - protein, 613 aa, ASPERGILLUS NIDULANS FGSC A4
MFLNRIARFYRSCLFQIIIVGLVAFCEPGIWTALNNLGAGGNASPFLNNAANALTYGLMSVGCFLAGGVSNKITAKWTLFIGAAFYTPYAAGLYCHNRYGNEWFLLLGASLCGIGASLLWASEAAIAVGYPEEDKRGRYVAIWMGIRQMGPLVGGAISLALNVNTAHVGKVTYTTYLGLVAISSLGAPFALLLSQPQEVFRSDGTKIPYMKKTSLAIEARAIWKQLRNKYMLLLIPVFLAGQFGATYQGNYLTSHLTTGTILDLKYFSRETRSKAVYIIVLVFVTASWTWNAVMQTKLSRMAEPPAFDLGDGPFFNSAFTVYMFFRFFYEVLQTYIYWLMAEIKGAQADGDVARTTGILRSWESIGSTIAYAVGATHWPNLNQMILGFALWGFTIPFTLLAVFGSWNQSQIAEADGESSGDDFETQRRRNTRHWLQRIILWGIRLVKALPRGGNGSGSTQQGRIEMAEFPPFSLQPLAQEVVELLKARRETVSVAETVYTLESRLAFAGWTQADRDKYTGPTTEIVGQMAGHTRRTLESTYAVSESGTAGPTGGTTRNRTPGYVAVAVSTANGDQTREVETGSSDRAQNMVAFARESLQLLKEVISQSVTPVL

SEQ ID NO: 18017 - protein, 141 aa, Geobacter metallireducens
MTQQGAIKTRLILIEDEPGHTRLITKNLMKSADVEILPFDTGRRALEYFEGKTAEDLRQHLVVLDINMPGIDGFEVLKRLKGNEATAAVPVIVFTTTDHPDEIRRCYHEGANLYLVKPMDYTAFQVTIDFLAATLTMMRLP

SEQ ID NO: 18018 - protein, 635 aa, Xanthomonas campestris pv. campestris str. ATCC 33913
MSHTPTPAAGSGHAPANGHMALVIGAIGVVFGDIGTSPLYTLKEAFSPHYGLTSDHDTVLGVLSLAFWALMITVTLKYVTIIMRADNEGEGGIMALMALTQRTLKQGSRSAYVVGILGIFGASLFFGDGVITPAISVMGAVEGLEIAAPSLHPFIVPITVVVLLVVFMVQRFGTEKVGKVFGPITCLWFLSLGAIGIWNIVDAPEVLKAFNPWWAIRFFMEHGWHGVFILGAVVLAVTGGEALYADMGHFGARPIRHGWYFFVLPMLLLNYLGQGALVLNHPAALKNPFFEAVPSWALYPMIILATLAAVIASQAVITGAYSVARQAMQLGYIPRMLIKHTSRDTIGQIYVPGINWLLMVMVIALVLIFRSSTNLAVAYGISVSMTMLIDTLLLALVARSLWPRWRNWVLPLCVVFFIIELAFVIANGAKLLQGAWFPLALGIVVFTLMRTWRRGRALLREEIRKDGIRIDSFLPGLMLAPPARVPGMAVFLTADPMVVPHALMHNLKHNKVLHERNIFLNVDTLPIPYAPADKRLQIESIGDEFYRVYVRFGFMETPDVPLALMRSCDQGGIHFDPMDTTFFASRETIVASANRGMPIWRDKLFALMHRNAAPATGFFRIPGNRLVELGAQVEI

SEQ ID NO: 18019 - protein, 311 aa, Pyrococcus furiosus DSM 3638
MITAFGEVLIDFIAAEEGDLENVKIFEKHPGGAPANVAVGVSRLGIPSFLVSKVGDDPFGRFLIRRLKEEGVNTEGVLIDNEKHTGVVFVQLKGAKPSFILYDEVAYFNIKLSEVPWEILESSKIVHFGSVLLAREPSRGTMIKVIETLKEKSLVSFDVNIRKDLWRSEEELVETLKRVLSNVDILKLSDEEFNLLKEYGLEPRGKLITAITYGAEGCRIESDEASIFVPAYKVSPVDTTGAGDAFVSALLVGLLALDKQKLEESDMFLLGKFANLVAGLSTQKRGAWSVPRREELEKYEEGRKIFSLITL

SEQ ID NO: 18020 - protein, 323 aa, Chloroflexus aurantiacus
MTNSYRVCMIVCLGIVSGNRMTMIVAFGNPVYDEIITPVVSTGGRVLSGCSTNACLALSRLGRTTALVGRVGPDYADRFQSDLLRYGITPFVSLSAQTGGFKLVYDTRGDRTLDVLGVAEPIQTVPDIVTSASAVIVGPILQETPLDLIRSIRDRTDAPIFLDPQGLLRRFGVDGRIEHFLPDDFAAIAPLCHVIKANEVETKVITGIDPRVDPAAAARRLRETGCAIAIVTIAEAGSHIDDGERSIPVPAYATDARDPTGAGDTYMAGFIHSYLSAPHDLFRAGCTGAATASIWIEYTGPDAPISLGEVERRTMSLLLQSKL

SEQ ID NO: 18021 - protein, 135 aa, Zea mays; identical to SEQ ID NO: 3015

SEQ ID NO: 18022 - protein, 84 aa, Oryza sativa (japonica cultivar-group)
MKVKILQWHGVASWTWNAQDETCGICRMAFDGCCPDCKFPGDDCPLIWGSCNHAFHLHCILKWVNSQTSTPLCPMCRREWQFKG

SEQ ID NO: 18023 - protein, 354 aa, Pseudomonas fluorescens PfO-1
MMCREGPDLCAGCVGRRTVHTAIHRPGVIRLPGAASSHGVPAIPWGETSEPGMQALLNEILDAVRPLIGQGKVADYIPALGTVPANQLGIAVYGNDGEMYCAGDAETPFSVQSISKVFSLVQAIEHSGEAIWERLGHEPSGQPFNSLVQLEFERGRPRNPFINAGALVICDINQSRFAAPALSMRDFVRRLSGNPQVMVDGKVADSEYQHRARNAAMAYLMQSFGNFHNDVEAVLRSYFSHCALRMNCIDLARAFCFLANDGFCKHSGEQILTRRQTQQVNSIMATSGLYDEAGNFAYRVGLPGKSGVGGGIVAVVPGQFTVCVWSPELNTAGNSLAGMAALEMLSSRIGWSVF

SEQ ID NO: 18024 - protein, 196 aa, Glycine max
  unsure (1)..(196): unsure at all Xaa locations
MVLEATMICIDNSEWMRNGDYSPSRFQAQADAANLICGAKTQSNPENTVGVLTMAGKGVRVLVTPTSDLGKILACMHGLEIGGEMNLAAGIQVAQLALKHRQNKKQQQRIIVFAGGPVNHEKKMLEMIGRKLKKNSVALDVVNFGEEDEGMTCXLEALLSAVINNDTSLIVHVPSCPNALSDVLISTFIFTGEGWG

SEQ ID NO: 18025 - protein, 431 aa, Ralstonia metallidurans
MLDAAVSAARNALPSWAKTTWAERQELLGRIGSVYLAHQEELARLLTAEQGKPLSRARTEVAGAAYWFAEFARMTLPDLIVQDNDQAYIVVRRVPVGVVGAMVPWNYPVILAAWKIAPALLTGNTLVLKPSPFTPLVTLRVGELMRDVLPPGVLNIVSGGDSLGPRMSAHPGFDKLSFTGSTVTGKRVMESASKDLKRLTLELGGNDAAIVMPDVDIEEVATKLFWGAFVNSGQICIAAKRVFIHESIYDKFSEVLVRLAKSTPMGPGDRDGVELGPVQNRAQFDRLCGLLQDCKDRGFNLLTGGEVEKGPGLFFPVTLVDNPSDDSRIVREEPFGPILPLLKFRSIPEVIERANASEYGLAGSVWCRDESIAMDIARRLQTGTVWINQIQAVTPHTPMAGHKQSGLGVENGEEGLASYTLPQTLSVKRAA

SEQ ID NO: 18026 - protein, 480 aa, Pseudomonas putida KT2440
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAEKLAAAVAKLKIGNGLEEGTTTGPLIDGKAVAKVQEHIEDAVSKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 18027 - protein, 135 aa, Haemophilus influenzae
EDPTPALEGADVVLISAGVARKPGMDRSDLFNINAGIVRGLIEKVAVTCPKACVGIITNPVNTTVAIVAEVLKKAGVYDKRKLFGVTTLDVLRSETFVAELKGLNVSRTSVPVIGGHSGVTILPLLSQVQYAKWN

SEQ ID NO: 18028 - protein, 257 aa, Pisum sativum
VSEYIDDIYHYYWVTEAHSQALSNYMSIQTEITPHMRGVLVNWLIEVHFKLDLMPETLYLTVTLLDQYLSQVTVKRSDMQLVGLTALLLASKYEDFWHPRVKDLISISAETYTRDQMLGMEKLILRKLKFRLNAPTPYVFMVRFIKAAQSNMKLEHMAFFLIDLCLVEYETLAFKPSLLCASTLYLARCTLQITPSWTPLLQKHARYDVSQIRDCADMMLKFHKAAGKGKLTVAYEKYSRKELSAVAGVKPLDRLPH

SEQ ID NO: 18029 - protein, 353 aa, Bacteroides thetaiotaomicron VPI-5482
MDFKIAVLAGDGIGPEISVQGVDVMSAVCEKFGHKVSYEYAICGADAIDKVGDPFPEETYEVCKNADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKVAFEYAMKRRKHLTVVDKANVLASSRLWRQIAQEMAPNYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDCKEEGALIRKAVDASLDENVRTPEIQVADGAKYGTKEVGQWIVDYIKKA

SEQ ID NO: 18030 - protein, 476 aa, Epymenia capensis
NERYESGVIPYAKMGYWDPDYVVKDTDILALFRVTPQPGVDPIEASAAVAGESSTATWTVVWTDLLTACDLYRAKAYKVDSVPNSSEQYFAYVAYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEAVNRSIAATGEVKGHYMNVTAATMEEIYERAEFAKQLGTVIVMIDLVIGYTAIQTMGIWARKNDMILHLHRAGNSTYSRQKSHGMNFRVICKWMRMAGVDHIHAGTVVGKLEGDPLMIRGFYNTLLFTHLDVNLPQGIFFEQDWASLRKVTPVASGGIHCGQMHQLLDYLGDDVVLQFGGGTIGHPDGIQAGATANRVALESIVIARNEGRDYVAEGPQILQNAAKTCGPLQTALDLWKDITFNYTSTDTADFVETPTANV

SEQ ID NO: 18031 - protein, 195 aa, Bacillus anthracis str. Ames
MILMIDNYDSFTFNLVQFLGELGQELVVKRNDEVTISDIENMKPDFLMISPGPCSPNEAGISMDVIRYFAGKIPIFGVCLGHQSIAQVFGGEVVRAERLMHGKTSPMHHDGKTIFSDIPNPFTATRYHSLIVKKETLPDCLEVTSWTEEGEIMALRHTTLPIEGVQFHPESIMTSHGKELLQNFIRKYSPSVTSC

SEQ ID NO: 18032 - protein, 589 aa, Zea mays
MVEQGKPRSIPTKAKKSPFVEVEVDEIGQASGVVFARESPLAPKSDQGCSVSHSHGDDETHESDGCVQSQGLDEHGWVDFGHSLQLVLFSRQWSLAESLVDLADQQPMLDYGLSIALDAIWFLRTKQDLEGLNSLISKIVASGAKDFARAILRTSLLASCVAACQSKAITVGNSKEIVAERLHDRLRDCPGAEHLKIEAGAKVQKFMEWALQCIHMHHCSEDTHMYRWNYNTLQEVQLHVSAFRTFLDIAGDNLSGKIFTEAFDAVCFPLTLFSSLFEPGWSSGSSAVSIKGLLSLLVEGGADNVNQCFLEAARFGSTELVRILLKVAYQNSLAVDTDLALVYASHYCKFKTMECLVDEGNVSSFLGPLIKAAERGCLQVVHWFVSRGVSDIEMCLALTTAASSGHFVVASYMLAHIPQQILEALSTQILKAARGQGSRPLDGVTFLLRSNFLRDAAATYEAADIIATGGTNGELPDLVAFLKEHWSQDAFAEGVSAGEMHFVNVMRVLRRGASPICLEDLPPEMVLGITYLPLYRECLSAGGQLLPQRLRGELLEAVHRLGEPVGPESQGKDLVLALERHMPSFLVGS

SEQ ID NO: 18033 - protein, 191 aa, Syrrhopodon banksii
GGAKKVVISAPSKDAPMFVMGVNEEKYTSEDIVSNASCTTNCLAPLAKVINDKFGILEGLMTTVHATTATQKTVDGPSNKDWRGGRSAATNIIPSATGAAKAVGKVLPELNGKLTGMAFRVPTTDVSVVDLTVRLQKPASYDTIKAALKDASEGKLKGILGYTEDDVVSSDFITDSRSSIVDAKAGIALSD

SEQ ID NO: 18034 - protein, 226 aa, Yersinia pestis KIM
MSPFTLRNQVFNFMTDKAHQCVIIGIAGASASGKSLIASTLYRELREQVGDQHIGVIPEDGYYKDQSHLSMEERVKTNYDHPSAMDHNLLLEHLQALKAGKPVELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 18035 - protein, 439 aa, Nicotiana tabacum
MQQPHHQQRELPFTSSKPPLGDYHRFSTDPLQQPEAILVKSTPLKRKSETTNYKQGVGAQITDSGYADVSSPMQTPISGKVGKAQKVPRTSKARSASQAATSNLGSPSGNNATPVGPCRYDSSLGLLTKKFINLIKHAEDGILDLNKAADTLEVQKRRIYDITNVLEGIGLIEKKLKNRIQWKGLDVSRPGEVDDSVTSLQAEVENMTIEERRLNEQTREMQERLTDLCEDENNQRWLLVTEDDIKSLPCLQNETLIAIKAPHGTTLEVPDPDEAVDYPQRRYRIVLRSTMGPIDVYLVSQFEEKFEEINAVEAPSAMPSTSGFNENDTATLPTEENGGVDGRIDEKENQSVCADVGTSQDFASGIMKIVSDVDNEEDYWLLSDADVSITDIWRADSVLDWNELNVIHEDYSIANVSTPRAQTPPSSTTELPSANTTGS

SEQ ID NO: 18036 - protein, 684 aa, GIBBERELLA ZEAE PH-1
MPDYDDMLPEPASGSHQDRTWGGNNAFHNFFNDFSHIPDPNLRRRLALSEIDKVPFGAYHIRAVLVAGVGFFLDSYDIFAINLITILLGVVFWGDPNPQNGFSGNDGYLPDRVNQAFKASTSAGIVVGMIWFWPTTPAMGSTGLLIFWRIIMGIGIGGDYPLSSVITSEFAPTRWRGAMVAAVFSMQGLGQLAAAIVALITTVAFKNAFVGVADESLCGFECRLAADRAWRIIVGVGAIPACAALYYRITIPETPRYTFDVELDVEKADADIKAYVASKSKGSFDVVHQVRSKRSSTRGLNVPRASWSDLIAFFRQWTNLKMLLGTTLSWFFLDLAFYGLGLNNTFILHAVGYGAGNNLFEKLQNQAVGMIILTCAGSLPGYWMAILTVDTIGRKPLQVIGFLLLTILFCVLGFTYNNLTQGGLLALYIVGQFLFNAGPNTTTFIVPGECFPTRYRSTGHGISAAMGKIGAIVAQAISIPMVRQGASENCKDAECTPNMHRLLQLFALFMLFGTFTSLLIPETKGMTLEELSGEPRTSYNSGCNGSISLGSPKLRAWNPFHGGQPAGFSYPRSRASQFRKSDRVGIMTSPELMAETSRLRKTRLWRRHRKAKSSSGTDIALSTRSSGTADDDIFPAGPPAATTTSPPPPPPPSWGAGWGRIDRGGPPPLLNSVQLQDVGSLLTK

SEQ ID NO: 18037 - protein, 483 aa, Rhodobacter sphaeroides
MRAQPAASHFVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGMGPVDAPY

SEQ ID NO: 18038 - protein, 460 aa, Chondrus canaliculatus
RDPDYVVKDTDVLELFRVSPQPGVDPVEASAAVAGESSTATGTVGWTDLLTACDLYRAKAYKVDTVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQMYERAEFAKELGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGATANRVALESMVIARNEGRDYVGEGPQILQDAAKTCGPLQTALDLWKDISFNYTSTDTADFVETPTANV

SEQ ID NO: 18039 - protein, 708 aa, GIBBERELLA ZEAE PH-1
MASEPENGKGKEPCETTPLMDSHQHSIPLMLPDTRESIPYNDYHTIDWLQDLIKDNQSHDLSTLHTRRGIRHRVSEIWDASQGWVAAFSIGLLTACVAAVVDAWKPWTESYISAYAVYVTMSLAFGIIAGSVTMTTKSKLKSVALEDEQSKRNAKHAPKSGGKTMYMAAGSGIPEIKTVLSGFSIPHLFDLKVLIVKAVGATFAVATGMCLGKEGPFVHISACVGYLVTICFPKYANNQRKLREMLSVACSAGLSVAFGAPIGGVLFSYEEISTHFPRRVLWRSCLCSVVAAAALKELNPTGTGKLVLFETNYGVNYDALHYLVFVVLGICGGVFGGVFCRANFLWAKSFRKISIIKNWPVFELALVALVTAVLQFPNVLIRETGDIVMQRLLVDCNDIEEDWICQQEAKLSGKGTYYAWLISGTFVKLLLTTITFGCKVPSGIIIPAMDAGALFGRTIGQLVPDISPGVFAMVGSAAFLAGVSRMTVSLAVIMFELTGEVNFIPPFMIAILTAKWVADAISADGVYDLAQHLQGHPFLDAEAAIKKVREFRDDNGSATVDVLLPAKDTVDDAIVSVGPNHQVATSVLRNKLSKLQNQGCTDSGLLFVHESGICRGYVSQYKLDNVLQSMEERDGIPEPSEVHVLQGSLAQAIDRSPITISSKAPLEYAVELFGKLGVSYLVVTQEDTATVLGIVSTKHLLAFLDRFR

SEQ ID NO: 18040 - protein, 426 aa, Aquifex aeolicus VF5
MNKTTFENVYYWEGKAQIPQEGQFIKLKEDKTLEVPDNPIIPFIEGDGIGPEITQAMLLIINTAVEKTYNGSKKIYWVELLAGDKAEEKTGERLPQETLDVLKESIVGIKGPLGTPVGKGVRSINSALRRAFDYYSAVRPVYWMGQATPIPNPERVDLVVFRENTDDVYAGVEFFAGTPEAKKVREFLIKEMGAKEEGFPEDVGITVKPMSEFKTKRHVRKALRYALENNKKNVAVIGKGNIMKATEGAFINWAFEVAEEPEFKGKVVTDPEAEPGEGQVKLTKVITDQMLMQLVLKPEAWDVIIAQNLNGDYVSDLAASLIGGPGFVPSGNIGDGYALFESTHGTAWDIAGKGIANPLSLTLSGAMMLEYIGWKEAAQKVYDAVRRTLAEHIGTPDIASGFQKQGIEAKAVGTMEFAEEISKRIE

SEQ ID NO: 18041 - protein, 217 aa, Vicia faba
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYHIVSKKTVEGAENGNASVPAKGEKIDLKNDVSALKRVGCCSS

SEQ ID NO: 18042 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 18043 - protein, 447 aa, Arabidopsis thaliana
MATHAALAVSRIPVTQRLQSKSAIHSFPAQCSSKRLEVAEFSGLRMSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 18044 - protein, 180 aa, Glycine max
  unsure (1)..(180): unsure at all Xaa locations
MEWQDCTVKMEIDVPISVAYTCYSDREAIPNWMPFISSVKILPDKPDLSRWSLKYKAFGRDIEFSWLARNMQEKIPNLILYLFFSINSLYLQLLFVIHVISPXLQPIPNQKIHWRSMEGLPNRGAVRFYPKGPSSCVVELTVSYEVPQLLAPVASALQPFLEGLLQRGLERFATFAKSYT

SEQ ID NO: 18045 - protein, 488 aa, Vaucheria prona
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAASTGEVKGSYLNATAGTMEEMYERAEYAKKLGTIIVMIDLVVGYTAIQSMAIWARKADMILHLHRAGNSTYARQKNHGINFRVICKWMRMAGVDHIHAGTVVGKLEGDPLMVKGFYNTLLDTKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 18046 - protein, 326 aa, Lycopersicon esculentum
LGANAILAVSLAVCKAGAAVKKIPLYKHIANLAGNKKLVLPVPAFNVINGGSHAGNKLAMQEFMILPVGASSFKEAMKMGCEVYHHLKAVIKKKYGQDATNVGDEGGFAPNIQENKEGLELLKTAIEKAGYTGKVVIGMDVAASEFYGKDKTYDLNFKEENNNGSQKISGDQLKDLYKSFVSEYPIVSIEDPFDQDDWETYAKLTAEIGQKVQIVGDDLLVTNPKRVAKAISEKTCNALLLKVNQIGSVTESIEAVKMSKQAGWGVMTSHRSGETEDTFIADLAVGLSTGQIKTGAPCRSERLAKYNQLLRIEEELGSDAVYAGAS

SEQ ID NO: 18047 - protein, 136 aa, Zea mays
MDARMFGLENPLVAALHHLLDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 18048 - protein, 479 aa, Desulfitobacterium hafniense
MKKEIRESLFIDGEWQEAINKEVKGVINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 18049 - protein, 343 aa, Glycine max
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKKSVS

SEQ ID NO: 18050 - protein, 354 aa, Hypocrea virens
MCFGARNKNEDGEARSRELDKGIRQEEKRMAKEVKLLLLGAGESGKSTILKQMKLIYAQGFNKSERLDFKPVIFSNIVQSFKTISEAMAEMGFEYDSPDNEKYMAHILVDNEISPDSGMPEDYLEPIKALWQDSGVLAAVSKGNEYALHDNLTYFVTDIDRIWADGYVPNDQDLLRSRLRTTGITETVFDLGQLTYRMFDVGGQRSERKKWIHCFENVNCLLFLVAISGYDQCLVEDKDGNQMNEALMLWESIANSHWFTMTSLILFLNKIDLFKEKLPKSPISKYGFTDYHGPDDDYKAASKYFLDKFRALSRNPEKEIYGHFTNATDTNLLKITMGSVQDMIIQRNLKKLIL

SEQ ID NO: 18051 - protein, 338 aa, Sclerotinia sclerotiorum
MAPTKVGINGFGRIGRIVFRNAIEHDDIDIVAVNDPFIETEYAAYMLKYDSTHGQFKGDIKVLSDGLEVNGKKVKFYTERDPANIPWAESEAYYVVESTGVFTTTEKAKAHLKGGAKKVVISAPSADAPMYVMGVNNETYNGEADVISNASCTTNCLAPLAKVINDEFTIIESLMTTIHSYTATQKTVDGPSAKDWRGGRTAAQNIIPSSTGAAKAVGKVIPELNGKLTGMSMRVPTATVSVVDLTVRIEKAASYDEIKEVIKKAANGPLKGILAYTEDDVVSTDMNGDNHSSIFDAKAGISLNKNFVKLVSWYDNEWGYSRRVLDLLHYISKVDNKQ

SEQ ID NO: 18052 - protein, 300 aa, Zea mays; identical to SEQ ID NO: 5214

SEQ ID NO: 18053 - protein, 335 aa, Xylella fastidiosa 9a5c
MTQTITVIRGDGIGPEIMDATLLVLNTLQANLNYEFADAGLNALEKHGDLLPEATLNSISKNKVALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNACMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMEFAKAIASRL

SEQ ID NO: 18054 - protein, 337 aa, Oryza sativa (japonica cultivar-group); identical to SEQ ID NO: 11856

SEQ ID NO: 18055 - protein, 200 aa, Streptomyces coelicolor
AWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRV

SEQ ID NO: 18056 - protein, 460 aa, Delesseria decipiens
WDPNYVIKETDVLSLFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRMPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMEDMYERAEFAKDLGTVIIMVDLVIGYTAIQSMAIWSRKNDMILHLHRAGNSTYSRQKIHGMNFRVICKWMRMAGVDHIHAGTVVGKLEGDPLMIKGFYNTLLLPYLETNLPQGIFFQQDWAALRKVTPVASGGIHCGQMHQLLDYLGNDVVLQFGGGTIGHPDGIQAGATANRVALESMVIARNEMRDYVTEGPQILRDAAKTCGPLQTALDLWKDISFNYTSTDTADFVETPTANV

SEQ ID NO: 18057 - protein, 216 aa, Ferroplasma acidarmanus
MNNMEISPSIISSNLLELGTQIKECQDAGAGSFHLDIMDGHFVDNITMGPDLVAAIRKGTNLRLDCHLMIERPDRYYKSFINAGADVLLIHYETPIEVINLIKKFQDENIRYGIVINPDTDVKKIYKLIPGSEIVLVMSVFPGFSGQKFIEKSLEKVKALREFIDENNYSTRIEIDGGINNETGKLAVEAGADILVSASYIFKNGINESIKKLKSL

SEQ ID NO: 18058 - protein, 290 aa, Triticum aestivum
MAGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVLLLNIAGFGLIFLLTVFAFQGETRVVSLGWICVGFSVWVFVAPLSIIGRVIKTKSVEYMPFTLSLTLTLSAIVWFLYGLLIKDKYVALPNILGFTFGVIQMVLYVFYMNKTPVASEVKEGKEAWKVPAEDHVVVINVGKADKSSCAEVRPVTEMAGAVDVPRRCAAEAAAAPGMDFARSVDVV

SEQ ID NO: 18059 - protein, 614 aa, Arabidopsis thaliana
MMGSILLLLLFFSLVQSRSDTSYSKIQLPGDSLTLSVTDFGATGDGINYDTSAIQSTIDACNRHYTSFSSICRVVFPSGNYLTAKLHLRSGVILDVTENAVLLGGPRIEDYYPAETSSDWYVVVANNATDVGITGGGAIDGQGSKFVVRFDEKKNVMVSWNQTGACLGDECRPRLVGFVDSINVEIWNITLREPAYWCLHIVRCENTSVHDVSILGDFNTPNNDGIDIEDSNNTVITRCHIDTGDDAICPKTYTGPLYNLTATDCWIRTKSSAIKLGSASWFDFKGLVFDNITIFESHRGLGMQIRDGGNVSDVTFSNINISTRYYDPSWWGRAEPIYITTCPRDSSAKEGSISNLLFVNITIDSENGVFLSGSPNGLLSDIKFKNMNLTFRRWSNYSAGLVDYRPGCQGLVNHRATSGIIMEHVNGFRVENVDLKWSDDDDVNAAWNVPLEFRPSTVNNVSFVGFTSGLYTKLFESDYVMSLFTSNHQYITESEIGITKMASTKPLIVAAKTLRNRIHFRSGSTSTGPSRWATPGHEERPKGYFMNRTPPPPGQSRKWEDWELPCYITSFLTIVILGVGLNAKPDLSIETWAHQKALERLEMEKLASAGDSSG

SEQ ID NO: 18060 - protein, 340 aa, Streptococcus pyogenes M1 GAS
MTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 18061 - protein, 334 aa, Pseudomonas fluorescens PfO-1
MMRNQSNDTSSVSLIVGSVMSCHEPVRPAASDMPVYLNLALVTMIWGGTWVAGRFLAGSLSPVFAASLRFLLASVALLGFLRLARIALARPTPRQWLQLALLGFFGIFFYNLCFFYGLRYINASRASLIVALNPAVIGLASWLLFKERLSRLKVIGIVICIGGAGVVIVSRHPQLLSETPDAWIGDLLILGCVLSWGVYSLFSRSLNQSIGPVQTVTFSILLGTLMLWALALSRGEVDVAALAALGSRQWLSLAYLGVLGSALAYIGYYDGIRKIGATRSGVFIALNPLTAVLAGAILLGEQLTLAMCLGGALILTGIWLCNKPLAPAGKKRIL

SEQ ID NO: 18062 - protein, 483 aa, Streptomyces coelicolor A3(2)
MRHRLSELSELSDLSEPSERLPDELRVLNPATEEVVATVPAASAADVDAAVARAARAQTAWAALAPGDRARLLRRFAVTVDEHLEELARLEVRQAGHLLGNARWEAGNVRDLLDYAAGGVERLTGRQIPVAGGLDVTLLEPLGVVGVIAPWNFPMPIAAWATAPALAAGNAVLLKPAETTPLTALRLAELALVAGLPEDLFQVLPGHGPVAGDALVEHPDVAKIVFTGSTAVGRQVAAKGAALLKPVTLELGGKSPNIVFADADVEAAAAATPMSFLDNSGQDCCARTRILVQRSVHDRFLELLAPAIEAVRVGDPADESTEMGPLISRAQLERVRSHVPADAAGIRGRAPRGGPGFWFPPTVLTGVDAHARVAVEEVFGPVAVVLPFDDEADAVRLANATDYGLAGSLWTRDVGRALRVSGAVRAGNLSVNSHASVRYWTPFGGFKQSGIGRELGPDALTAFTETKNVFFSTTPSSTEGPAQ

SEQ ID NO: 18063 - protein, 173 aa, Zea mays
IGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCATVCTLLGLPILRINVVFTAITSIATLGWVGGYAVPIFARMVMRENDFRPGPFYLGRTR

SEQ ID NO: 18064 - protein, 456 aa, Dictyopteris divaricata
YNVKDTDILALFRITPQPRVDPVEAAAAVAGESSTATWTVVWTDLLTACDIYRAKAYRVDPVPGTTDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLRGGLDFLKDDENINSQPFMRWKERFLYCMEGVNRAAAATGEIKGSYLNITSATIEQMYERAEYADSLGTVIVMVDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAIVLARNEGRDYVEEGPEILRNAATTCGPLKAALDLWKDITFEYTSTDTPDFVEVPTTGN

SEQ ID NO: 18065 - protein, 168 aa, Bacillus subtilis subsp. subtilis str. 168
MNIYVEANPYLHDKYSKYADEKYKREGNPFVSFPIHFDDIPSGAKTLALTFIDHDAIPVCGFSWIHWTAANIPAYIGELPEHASEERQDLMIQGQNSFASPLAGSNDPKVIHQYCGPTPPDKDHAYTLTVYALDAELNLQPGFYLNELYQEMKEHILAETSIELLARV

SEQ ID NO: 18066 - protein, 761 aa, Arabidopsis thaliana
MWRLRIGAEARQDPHLFTTNNFAGRQIWEFDANGGSPEELAEVEEARLNFANNKSRFKASPDLFWRRQFLREKKFEQKIPRVRIEDAEKITYEDAKTALRRGVLYYAACQANDGHWPSEVSGSMFLDAPFVICLYITGHLEKIFTLEHVKELLRYMYNTQNEDGGWGLDVESHSVMFCTVLNYICLRILGVEPDHDGQKSACARARKWILDHGGATYAPMVAKAWLSVLGVYDWSGCKPLPPEIWMLPSFSPINGGTLWIYIRDLLMGMSYLYGKKFVATPTALILQLREELYPQPYSKIIWSKARNRCAKEDLLYPKSFGQDLFWEGVHMLSENIINRWPLNKFVRQRALRTTMELVHYHDETTHYITGACVAKPFHMLACWVEDPDGDYFKKHLARVPDFIWIAEDGLKFQLMGMQSWNAALSLQVMLAANMDDEIRSTLIKGYDFLKQSQISENPQGDHLKMFRDITKGGWTFQDREQGLPISDGTAESIECCIHFHRMPSEFIGEKMDVEKLYDAVNFLIYLQSDNGGMPVWEPAPGKKWLEWLSPVEHVENTVVEQEYLECTGSVIAGLVCFKKEFPDHRPKEIEKLIKKGLKYIEDLQMPDGSWYGNWGVCFTYGTLFAVRGLAAAGKTFGNSEAIRRAVQFILNTQNAEGGWGESALSCPNKKYIPSKGNVTNVVNTGQAMMVLLIGGQMERDPSPVHRAAKVLINSQLDIGDFPQQERRGIYMNMLLHYPTYRNMFSLWALALYTNALRLLVS

SEQ ID NO: 18067 - protein, 778 aa, Thermotoga neapolitana
MELYRDPSQPVEVRVKDLLSRMTLEEKIAQLGSVWGYELIDERGKFKREKAKDLLKNGIGQITRPGGSTNLEPQEAAELVNEIQRFLVEETRLGIPAMIHEECLTGYMGLGGTNFPQAIAMASTWDPDLIEKMTAAIREDMRKLGAHQGLAPVLDVARDPRWGRTEETFGESPYLVARMGVSYVKGLQGENIKEGVVATVKHFAGYSASEGGKNWAPTNIPEREFREVFLFPFEAAVKEARVLSVMNSYSEIDGVPCAANRRLLTDILRKDWGFEGIVVSDYFAVNMLGEYHRIAKDKSESARLALEAGIDVELPKTDCYQHLKDLVEKGIVPESLIDEAVSRVLKLKFMLGLFENPYVDVEKAKIESHRDLALEIARKSIILLKNDGTLPLQKNKKVALIGPNAGEVRNLLGDYMYLAHIRALLDNIDDVFGNPQIPRENYERLKKSIEEHMKSIPSVLDAFKEEGIDFEYAKGCEVTGEDRSGFKEAIEVAKRSDVAIVVVGDRSGLTLDCTTGESRDMANLKLPGVQEELVLEIAKTGKPVVLVLITGRPYSLKNLVDRVNAILQVWLPGEAGGRAIVDVIYGKVNPSGKLPISFPRSAGQIPVFHYVKPSGGRSHWHGDYVDESTKPLFPFGHGLSYTRFEYSNLRIEPKEVPSAGEVVIKVDVENVGDMDGDEVVQLYIGREFASVTRPVKELKGFKRVSLKAKEKKTVVFRLHTDVLAYYDRDMKLVVEPGEFRVMVGSSSEDIRLTGSFSVTGSKREVVGKRKFFTEVYEE

SEQ ID NO: 18068 - protein, 359 aa, Salmonella typhimurium
MSTENTLSVADLARENVRNLVPYQSARRLGGNGDVWLNANEFPTAVEFQLTQQTLNRYPECQPKAVIENYAQYAGVKPEQVLVSRGADEGIELVIRAFCEPGKDAILYCPPTYGMYSVSAETIGVERRTVPALENWQLDLQGISDNLDGTKVVFVCSPNNPTGQLINPQDLRTLLELTRGKAIVVADEAYIEFCPQATLTGWLVEYPHLVILRTLSKAFALAGLRRGFTLANEEVINLLLKVIAPYPLSTPVADIAAQASCPQESNAMRDRVAQTVQERQYLVNALQQTACVEHVFDSETNYILARFTASSSVFKSLWDQGIILRDQNKQPSLSGCLRITVGTRQENQPVIDALRAEPV

SEQ ID NO: 18069 - protein, 348 aa, Chlorobium tepidum TLS
MLNPALEHIETYKVEGGQEAEVKLNQNENPFDLPSWLKDKILDQFRHEPWNRYPDILPYRGMAAYASFLGVKPELVIMSNGSNEMLYTIFMACLGAGRKVLIPEPSFSLYDKLARLQQAGVVEVPMHDDLSFDVDAIIEAARREKVDFIVLSTPNNPTSKSLSHDEIERIVEAADAIVLVDEAYVEFSREQSALDLIDRYPNLIVLRTMSKALALAGMRIGFAIANPELLAEISKPKIPFASSRLAEITLMAVLENYSLVTDAVQYILAERGRIEAELTEIPGIHTFESDTNFLIIRVANASEVFRKLKNAGVLVRNVSGYPLMENCLRFNVGLREENDRLLELLKKL

SEQ ID NO: 18070 - protein, 508 aa, Nitrosomonas europaea ATCC 19718
MYCREDLKESFPMLLGLLSFFVQTVFFVVVAYFALYVLLELRILFISRRVERCKLTELTEAVQPSLRVGDDYKPSVSVLLPVHNESFVVERLIDAACRLRYPADLLEILVLDDSSDDTSRLARARVEQYAARGVNIRHVCRNDRQGYKAGNLAHGIHQASGEFFAIFDADFVPPPDFLLKTIPYFRDPQLGFLQTGIGYENKNKSFLTRFQAMEMGHQQYVTVGLSEEGDMASLSGSSCVWRKSCVEVLGGWNTSMVTEDVDLGYRAQFGEWKYAYLRDVVSMSLLPESVSAFRVQRERWGRGLIHSGFKHVRQMLHQRMPLMKRLHAISMMFSSVLLASIYVLVLLSLPLNYLVDFDNATMQWVLLAFFGLVAVWGLDNAFGARKGARLDEKPGALRTLWGIYLYIAMFLPMAWYYFAGGIRALLGVHGEFNRTPKGMDERRARMPRINMILLAGELFTFVYSMLAILAAVQKGNYFLIPLNFTVCVGFGMVLFWSWRGIRGNEQAT

SEQ ID NO: 18071 - protein, 158 aa, Glycine max
KGLRYPLPLPVSLVGAPPASCSLRSPRARSMASGDSKPRSEEEWRAVLNPEQFRILRLKGTELPGTGEYNKFYGDGAYNCVGCGTPLYKSTTKFDSGCGWPAFFEGLTGAIHRTPDPDGRRVEITCAACGGHLGHVFKGEGFKTPTDERHCVNSVSIK

SEQ ID NO: 18072 - protein, 191 aa, Zea mays
MSSLSPEQRPCLSRRVTVQEQISSSFMDSPPPPHLDAPLFGADLIPSGRLRRMRGWRHSPGGLEEEIRMFQTRVLLGGMNMYDRYQDWRLDVDNMTYEELLELGDKIGYVNTGLRDDEITRNLRKVKHPSFSSLRFATEMERKCSICQEEFETNEEMGRLDCGHSYHVYCIKQWLSQKNICPVCKTAVSKN

SEQ ID NO: 18073 - protein, 575 aa, Neisseria meningitidis MC58
MQLSGAQIIVQSLKAEGVEYVFGYPGGAVIEIYDALFQLNKFKHILTRHEQAAVHAADAYARVSGKVGVALVTSGPGVTNALTGIATAYTDSIPMVVISGQVGNSLIGTDAFQEVDTVGITRPCVKHNFLVTDINELAETIKKAFQIAASGRPGPVVVDVPKDVTQAMAKFSYPQEDIFIRSYQPVVQGHIGQIKKAVQMLASAKRPVVYFGGGVVLGNASEELTRFVRMTGAPCTGTLMGLGAYPSGDRQFLGMLGMHGTYEANLAMQNADVVLAVGARFDDRVVSVPSKFFEKAKKVIHIDVDPSSIAKRVKVDIPIVGDVKNVLSEMVALWQKQESVPSEDALGKWWKTIEEWRSRDCLWFDNGSEIIKPQYVIQKLAEITGNSAIITSDVGQHQMFAAQYYPFERPRQWLNSGGLGTMGVGLPYAIGAKLAAPDQDVFCITGDGSIQMNIQELSTCFQYRIPVNVITLNNGYLGMVRQWQEIYYGGRESETYFDSLPDFVKLAEAYGHIGIRVDKKSDVEGALLEALNQKDRLVFIDFLTDQKQNVMPMVGNGKGLDEMVLPPHMRADGKA

SEQ ID NO: 18074 - protein, 113 aa, Zea mays
  unsure (1)..(113): unsure at all Xaa locations
RHRDERVDYXPSRXAPLRQAAPPXTPMPHRPVAGRREKATIRKPNDFKQPGERYRSWDADRQDRFVRRFADSLGHPKVSQELRSIWIDLLAKVRGWHGMAVAHVFSFHLATHA

SEQ ID NO: 18075 - protein, 294 aa, Enterobacter aerogenes
IVFRAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNRSCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 18076 - protein, 759 aa, ASPERGILLUS NIDULANS FGSC A4
MLLTLVSRGLLLLQLCAGLTAAKGSRPLYKDPNAAIEDRVSDLLGRMTLEDKVGQLMQGDITNWMNADTGEFNYTGLEENMKIKAGMFYVGYPVPWDWIATNVKRAQDYLLENTTLGIPAFVQTEAIHGFLIGNATIYNSPIAYGCSFNRKTSPASSDLVAGSNAAQVEETYSEDPYLAGEIGYQYVTGLQSLNVSAQVKHYAGFSQPEQGINTAPVHGGERYLRTTWLPPFKRAIIDAGAYSVMSAYHSYDGIPAVADYHLLTEILREEWGYEYFVISDAGATDRLCNAFHTCESSPIDSESVTLQALPAGNDVEMGGGSFNFRTIPQLVESGQLDIETVDTAVSRVLRSKFALGLFENPYPGAPKEEWDNLIHSKEAVDLARQLDKESIVLLENHDNILPLKKTGNIAVIGPMAHGYMNYGDYVVYRSQYRGVTPLDGIKAAVGDSATVHYAQGCERWSNDQSGFEEAIAAAEKSDVAIVVVGTWSRDQQELWQGLNATTGEHVDVNDLSLVGAQGPLIKAIIDTGKPTVVVFSSGKPITETWLSNSASALVQQFYPSEQGGNALADVLFGDYNPSGKLSVSFPRYVGDLPIYYDYLNSGRSIGDSGYEAENGTLVFGHQYVLGSPEPWFPFGHGLSYVNFTYGEVSLSKTNVTASDTISVSVDITNSDSSRDGTEVVQIYIVDEITSVVVPNRQLKGFEKVFVPAGKTKTVTVDIDVADLGLWDARMNFVVEKGEFTVLVGSSSTDVRGNATFWVQ

SEQ ID NO: 18077 - protein, 327 aa, Oryza sativa
MPWAGEGGDTLFREIDATMEMRRLLVLFALLSVTAVVPVFLWPDKKGGASDVAVVVAAPPFNASSVTIISWKPRIFFYKGFLSDDECDHLVKLGKEKLKRSMVADNESGKSVMSEVRTSSGMFLDKQQDPVVSGIEERIAAWTLLPQENAENIQILRYENGQKYDPHFDYFQDKVNQLQGGHRYATVLTYLSTVEKGGETVFPNAEGWESQPKDDSFSDCAKKGLAVKAVKGDSVLFFNLQPDGTPDPLSLHGSCPVIEGEKWSAPKWIHVRSYDNASSMKQSEECSDLSENCAAWAASGECNNNAVYMIGTEDAPGQCQKSCNACK

SEQ ID NO: 18078 - protein, 402 aa, Triticum aestivum
  unsure (1)..(402): unsure at all Xaa locations
MTQLQATPLRTLALSRRRGAGAAARPMAGSVRCSAAARSYSITLLPGDGIGPEVVAVAKDVLSVAGSKEGVELRFQEMLMGGAALDAAGVPLPDETLAAARAADPSIPASLGGYKGYNNDNNQKLWRHVTGRSINGHGKHWNXRPLPVLGNRDRVFLNRFTALLLTLLARTRQTRXATILSAAMLLKYGLGVESAAKRIEAAVTETLDNGFRTGDIXFSWDDIGWGKLCSVDKANVLEASMLWRKRVTAIASEFPDVELSHMYVDNAAMQLVRNPKQFDTIVTNNIFGDILSDEASMITGSIGMLPSASVGESGPGLFEPIHGSAPDIAGQDKANPLATILSAAMLLKYGLGVESAAKRIEAAVTETLDNGFRTGDIYSAGTTLVGCKRMGEEVLKALESQK

SEQ ID NO: 18079 - protein, 333 aa, Synechococcus sp. PCC 7942
MRVGINGFGRIGRLVLRAAWDWPELEFVQINEPYGEAAAAAHLLEFDSSQGRWSREITATVDSLTIEGRSLHYSRAKEPTAIDWAAQGVELVLECSGQFRTAEKLEPHFQAGVQTVIVSAPVKEALNIVVGVNDDRYDPSQHRLLTAASCTTNCLAPVVKVLQEAIGIRHGLITTIHDQTATQSIVDSYHKDLRRSRAAGQSLIPTSTGSATAIGLIFPELQGKLDGLAVRVPLLNASLTDAVFELERETSVAEVNGLFQAASSGSLQGILGYEERPLVSVDYRGDARSAIVDALSTRVINGTQVKVLAWYDNEWGYSNRLAELARKVARAAV

SEQ ID NO: 18080 - protein, 275 aa, Arabidopsis thaliana
QNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYT

SEQ ID NO: 18081 - protein, 497 aa, Nicotiana tabacum
MKKATVGAAVIGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVNEEGEKFQQPPGKQRELGFTFSFPVMQTSINSGTIMRWTKGFSIDDAVGQDVVGELAKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEEAGIFGDEVPPKLKSPFVLRTPDMSAMHHDASSDLRVVGDKLKDILEISNTSLKTRRLVIELCNIVATRGARLAAAGVLGILKKMGRDTPRQGGLEKTVVAMDGGLYEHYTEYRMCLENTLKELLGDELATSIVFEHSNDGSGIGAALLAASNSMYLEDKS

SEQ ID NO: 18082 - protein, 508 aa, Oryza sativa (japonica cultivar-group); identical to SEQ ID NO: 4306

SEQ ID NO: 18083 - protein, 312 aa, Clostridium beijerinckii
MNNNVFCIGELLIDMVCVDNKGLKNGEKFEKKAGGAPANVAASICKLEGNAYFLGQVGNDFFGKHLVELLKSLNINTDMTVERGSTTIALVGIDANGERNFDFLRGSDGEYSFDNIDLSKISNSDIIHFGSATGFLDGELKKTYFKLLEYAKSNNIYVSFDPNYRDALITQDKLELFVEDCVKFLRYSNFTKLSDEELYLITKEKDIESAVNKLHEIGVKVVTVTLGSKGTYLSVNGKNEIIPSIEIKQVDSTGAGDAFVGAVLRQVSDIDDKESISFDRWKEIVSFANKVGAITCTNYGAIASMPTLNELN

SEQ ID NO: 18084 - protein, 364 aa, Zea mays
MEASSRLELQQAHTELWNLTFSYLKSMALECVVQLNIPNVIHNFGGNATLPSILSAIQVPEHRKPYLPRLMRFLVVSGILSFDSPTLGEEGTYHLTPLSRLLVDDTHINGYGSLGPFVLSQTTKYHVSSATYLSEWFKGEDGAGPMAAEMPFKMAHGTGPWGALGHDQQFNRVFNAGLGSNSRLVLDFVVAEYGDVFDGVSSLLDVGGGDGSTARTIRKAFPHIKCSVLDLPNVIIDIQPGDGMVDYIAGDMFSSIPPTDAIMLKYVLHDWNDDDCVKILQQCKKAICSCKPAGGKVLIIDVVVGSPLKEMFEAQVTSDLLMMVIAGGKERDKKEWHKIFVESGFKDYKISPVLGYLSIIELYS

SEQ ID NO: 18085 - protein, 373 aa, Oryza sativa
  unsure (1)..(373): unsure at all Xaa locations
MWKLKIGEGAGNPLLRSPNGFLGRETWEFDPDAGTPEERAEVERLRRDFTRNRFTRRECGDLLMRMQFAKQNNLYTNLRVNNHKDSSEITEEVLLTALKRVLDQHSSXQAHDGHWPGGFSGVLFILPLMIFALHVTHSLNDVLSSEHIREICRYIYNIQNEDGGWSTLTLGPSTMFGSCVNYATLRLLGEELDGDDNALSKGRAWILTHGTATAAPQWAKIFLSVIGVYDWSGNNPIIPELWMLPYFLPIHPGRFWCFCRMVYMPMSYIYAKKFVGPITPTILAMRDELYNVPYSKINWNNARSSCCKDDIIYPPSWLQIVAMASLNNFVEPLFNLWPMNVLRQRALTNLMDHIHYEDENNYYIGLCPMNKVL

SEQ ID NO: 18086 - protein, 713 aa, Thermococcus kodakaraensis
MGRLVSVVLIVLLLTPIASAWEVPERGIIYQVMVDRFYDGNTSNNEPFYDPTHSNYRLYWGGDLEGLIEKLDYIKSLGVSMIWVSPLNDNINSLAYGSAPYHGYWTRDYKRIEEHFGGWEDFRRLVKEAKKRGICIIVDYVPNHSNPVNYGEYGALYDNGTFLTDYFKDTKNAEVNPITGIRENVYHHNGNIYTWSGIPLKYANLYGLADFNQLNPWVDSYLTEGAMLFVDSGACGLRIDAVKHMELGWLETFYLRLYSKGPLFIYGEYFTPSLQKGDDLYEFYRYSNVSPVLSIPIREDIVRIFAFFGGLDKLSEELGDYYSHFVYPTKAVNFLDSHDLVRFLNAGDRKDEIQRFHMALALTLTLPGIPVIYYGDESYLVSKDGKGDPYNRPTMVFDNTTEASRIIRTLGGLRKTNDALVFGDFMTVTASYETWAFERTFGNHSLLVVMNKGPAVNLTFSVDWPDGNYRDALYGGEMVVSGGKASVYLPRDSVYVFHIEGEQKKPLIGSITPYAARPGQEIVIGGAGFGKGGKVIIGGREAKVLSWEDGKIVVEVPRLETSAAWVNVTVVSDGGRSPPRPLRYYSGNDVPALIALNASLVGEVSGTLWLSGDLPELGEPRPLLKSSMGYYFTVAPLPEGVPFSVRLYEGKAWGALRPLNLTLYGVGNRTVTLTEKPPGVSEGQKAGQKDVALYALSVVMIAALIAVVWKRKG

SEQ ID NO: 18087 - protein, 281 aa, Glycine max
  unsure (1)..(281): unsure at all Xaa locations
FTCPTTMQELWDDSVTPNTTLYRLIHMWFSQKYLLMKKRSEDVQGRASELLETLKKVKSQARVQALKELHQLVASHATARKTVIDEGGVSVVSSLLGPFTSHAVGSEVIGILVTLTLDSESRKNLLQPAKVSLMVDILNEGSIETKINCTRLIESLIEEKDFRSEVILSHSLLVGLMRLVKDKRHNNGVCPGLSLLRTICLHKEVRNLLVSIGAVSQLVELLSGMEPDCLELALCVLDALASVPEGRVALKDCSNTIPIMVKLLMRISENCTQYALXILWS

SEQ ID NO: 18088 - protein, 531 aa, Triticum aestivum
MLSCPDDMAFEGAYHFLQLAVGHATSSPAALLLVVVPLLLLLLASVRRSTMTGRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFANGRQEEVCLVVNKIREAATTAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKKLDMITEEDLSSLPYLKATMKEALRLHPPGPLLLPHYSTADCSIDGYDIPAKTRILVNGWAIGRDPKAWERPEEFMPERFLQDGQEKSSNLGQDFKYLPFGSGRRICPGANFALATMEIMLVNLMYHFDWEVPNEKDGAGGKVSMAETFGLMLRRNEKLYLVPRIA

SEQ ID NO: 18089 - protein, 425 aa, Brucella suis 1330 [sequence omitted]

SEQ ID NO: 18090 - protein, 428 aa, Arabidopsis thaliana
MSTKGEHHTVPLSVLLKRESANEKIDNPELIHGQHNQSKKGEDFTLVKTECQRVMGDGVTTFSVFGLFDGHNGSAAAIYTKENLLNNVLAAIPSDLNRDEWVAALPRALVAGFVKTDKDFQERARTSGTTVTFVIVEGWVVSVASVGDSRCILEPAEGGVYYLSADHRLEINEEERDRVTASGGEVGRLNTGGGTEIGPLRCWPGGLCLSRSIGDLDVGEYIVPVPYVKQVKLSSAGGRLIISSDGVWDAISAEEALDCCRGLPPESSAEHIVKEAVGKKGIRDDTTCIVVDILPLEKPAASVPPPKKQGKGMLKSMFKRKTSDSSSNIEKEYAEPDVVEELFEEGSAMLSERLDTKYPLCNMFKLFMCAVCQVEVKPGEGVSIHAGSDNCRKLRPWDGPFLCASCQDKKDAMEGKRSSGDRHSSESD

SEQ ID NO: 18091 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 18092 - protein, 365 aa, Oryza sativa (indica cultivar-group)
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPASAVYTARPDHGVWRA

SEQ ID NO: 18093 - protein, 167 aa, Zea mays
  unsure (1)..(167): unsure at all Xaa locations
ITMDPTKFRPSSSHDTTVTTTNAGAPVWNDNEALTGGPRGPILLEDYHLXEKVAHFARERIPXERVVHARGASAKAFFEXTHDVTXSLTCADFLRAPXVXTPXVIVRSSTVSPERGSPEEIPDPGGFPVEFYPRGGNWDXLLGNNFPXVFFIPRGIRFPDVIPVVKA

SEQ ID NO: 18094 - protein, 275 aa, Glycine max
IRLEGIGLIEKKLKNRIQWKGLDVSRPGEADDSFASLQAEVENLTMKERQLDEQIREMQERLRDLSEDENNDKLLFVTEEDIKNLPCFQNETLIAIKAPHGTTLEVPDPDEAVDYLQRRYRIVLRSTMGPIDLYLVSQFEEKFEEINGADVAPKLPSSPDVTKQQSTVVPEDRGKHIEVQGQAAPGPSSDFTPSQDFVSGIMKIVPSDVASEADYWLLSDADVSITDMWRTEPGVEWNELEPLQEDYCMTDENTTTPSHPSNVGEVSSASKPTGG

SEQ ID NO: 18095 - protein, 635 aa, Eremothecium gossypii
MSKIDVKYSELNRPSLSLEFFPPKTDSGKSNLLARIERMSAMDPLFITVTWGAGGSTAEKTLELAALAQRELNIPVCMHLTCTNMDRTILDKALMRAKEAGIRNILALRGDMPLAADEEEHVDGGFLYAIDLVRYIKMQYGDYFCIGVAAYPDGHCEGEADGMEQDPMRDLPYLKEKVEAGASFVITQLFYDVEKFLAFEELFRREISETIPVFPGLMPINSFMLFNRAAKLSHASIPSHILDRFPHHIRHDDLKVKEIGVEIMVEIVNKVWERTSGRIKCFHFYTLNLEKSIAQIVTQSPVLSRIIDEDSEVEDSSGDVVVEDANASEADDLSYKKRRRQSSMQGEPESGMVMLDGPRRFSVRGAVPSRKVVISISKGSGTLGRDATWDEFPNGRFGDSRSPAYGEIDGYGPSLKVSNKKAYQIWGYPSTLNDIKSLFIGYLEGSIEALPWCDLGLSPETALIQEELIGLNQRGFLTLASQPATNSTPSADKIFGWGPPGGVVYQKAFVELFVEKARWEAELKPRLEGPDSKFSYYFGDSAGSFASNMAPESSSVVTWGVFPNSQILQTTIIEEESFKAWRDEAFSIWLSWSKLFPRNSPHNAFLRGIHRDYCLVSIVHHDFSSVDELWETLLR

SEQ ID NO: 18096 - protein, 384 aa, Schizosaccharomyces pombe
MFDLNTCLRKNILELQPYRCARDDFSEGVLLDANECAYGSVISVDGVEFNRYPDPRQIEVKQRLCDLRNKELSITKPLTPDNICMGVGSDEIIDSLIRISCIPGKDKILMCPPSYGMYTVSAKINDVEVVKVLLEPDFNLNVDAICETLSKDSAIKVFFACSPGNPTAKALKLEDIKKILEHPTWNGIVVVDEAYIDFSAPDMSALTLVNEYPNLAVCQTLSKSFGLAGIRIGFCLTSKPIATIMNSLKAPYNISEPTSRLALDALSPQSIDKMHTYRDAIIQQRVRLCKELTTIKGMGKIIGGYDANFILIQVLDRPEGGKPSNDAAKYLYLQMATMHKVVVRFRGTEPLCEGALRITVGTEEENTILLKTIKLVLQEYYTKK

SEQ ID NO: 18097 - protein, 387 aa, Zea mays
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVIRKTLKSDGIAGLYRGFNISCVGIIVYRGLYFGLYDSIKPVVLTGSLQDNFFASFALGWLITNGAGLASYPIDTVRRRMMMTSGEGVKYKSSLDAFQQILKKEGPKSLFKGAGANILRAIAGAGVLSGYDQLQILFFGKKYGSGGA

SEQ ID NO: 18098 - protein, 183 aa, Capsicum chinense
GAYGIVCSALNSETNENVAIKKVANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRPPELLLNSSDYTAAIDVWSVGCMF

SEQ ID NO: 18099 - protein, 487 aa, Eschscholzia californica
GTSTVALIAVIISSILYLLFGGSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGDPNSGSSEFKEYLWRMLELGNSTNPADYFPMLGKFDLFGQRKEVAECLKGIYAIWGAMLQERKLAKKVDGYKSKNDFVDVCLDSGLNDYQINALLMELFGAGTETSASTIEWAMTELTKNPKITAKIRSEIQTVVGERSVKESDFPNLPYLEATVKETLRLHPPTPLLLPRRALETCTILNYTIPKDCQIMVNAWGIGRDPKTWTDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 18100 - protein, 101 aa, Glycine max
MAQSSCKTLVQWLVAALLIALLGGAQAVAICNIDSSQLNLCRAAVTGQNPPPPDEKCCAVVRQANLRCLCSYKSTLPSFGINPKNALALPGKCGLQWPPNC

SEQ ID NO: 18101 - protein, 595 aa, Glycine max
  unsure (1)..(595): unsure at all Xaa locations
MKIIEKIRAASADPNRVVFSFEFFPPKTEDGVDNLFERMDRMVAHNPXFCDITWGAGGTTADLTLEIANKMQNIVCVETMMHLTCTNMPVEKIDHALHTIKSNGLQNVLALRGDPPHGQDKFVQVEGGFACARDLVQHIRAKYGDYFGITIAGYPEAHPDVIESDGLATPEGYQNDLAYLKSKVDAGADLIVTQLFYDTDIFLKFVNDCRQIGITCPIVPGIMPINNYKGFIRMTGFCKTKIPADIMAALEPIKDNEEAVKAYGIHLGTEMCKKILAHGINTLHLYTLNMEKSALAILMNLGLIEESKVSRSLPWRRPANVFRVKEDVRPIFWANRPKSYISRTIGWDQYPHGRWGDSCNPSYGALSDYQFMRPRARDKKLVEEWAVPLKSVEDIYERFRLYCLGKLRSNPWSELDGLQPETKIINEQLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEDEASRKLVEEVGGSHFLVSLVDNDYINGDLFAVFADF

SEQ ID NO: 18102 - protein, 480 aa, Martensia australis
  unsure (1)..(480): unsure at all Xaa locations
QAIKNERYESGVIPYAKMGYWDPNYVIKETDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAATGEVKGHYMNVTASTXXXXXXXXXXXXXXXXVIIMIDLVIGYTAIQTMAIWSRKNDMILHLHRAGNSTYSRQKVHGMNFRVICKWMRMAGVDHIHAGTVVGKLEGDPLMIRGFYNTLLDPYLDINLPQGIFFQQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 18103 - protein, 286 aa, Triticum aestivum
MAVSVLAILLASCALAAASFDKEFDVTWGDGRGKILDNGQLLTLGLDKVSGSGFQSKHEYLYGKIDMQLKLVPGNSAGTVTAYYLSSQGPTHDEIDFEFLGNVTGEPYTLHTNVFTQGQGQREQQFRLWFDPTNDFHTYSILWNPKHIIFMVDGTPIRDFKNHEARGVSFPKSQPMRLYASLWNADDWATQGGRVKTDWSKAPFVASFRNFNADACVMSGGAQRCPAGTMEASAAGANGSGSWWNQELSGMGYRRMRWVQRKFMIYNYCTDPKRVAQGVPAECKLR

SEQ ID NO: 18104 - protein, 545 aa, Magnetococcus sp. MC-1
MLSAFRSLKRLGGIWMILAQHNVMEPFARRYVPMRLLSWLVQLNPVIWRHCRRTPLHIRLRLALEELGPTFIKFGQTLSTRLDILPDEIGQELKRLQDDVPPFDLATVRQSIEEDLKRPLHELFRSFDEKPVASASIAQVHHAFTHDGDEVAVKVLRPDVAARVETDIAMLMTMASLVEELMPEWRRLKPRGVVKEFAQTIRNEMDFLVEASRAQKLGENFKDDVGMMIPQVYWPLTSSRVFTMAWIEGVSIDELPRERVAGRPDPRVVAERLLSSFFKQVFHDGYFHADQHPGNILVREDGVVALIDFGIVSHVSEQTRQFLAEMVQGFITRDYKKVAQVHLDAGYIPHDTDMDAFEEACRQIGEPVFGQPLKDISVARLLAKLFKTTEQYNMEVQPQLLLLQKTLFTLEGVGRELHPDLNAWEIAEPLVMAWMKARIGPKGQLLKLRRQLEEMGYAMGAAPEMAFQVLERVANDRFHIRLHASSMERVEHEIVLGFKRVWSAVMAGFLFLGGAVMAAAGMSPWWFVPPLILAFFSFFRVIALL

SEQ ID NO: 18105 - protein, 479 aa, Magnetococcus sp. MC-1
MQSGTPWICGTHTCSGYAADPQCSVYPGGNGAAWADLGGELARQHPWRTAQFASGCGSYSPCPKNGRWGRPLSPQGEPMIAFEEARARVLQSVTPMLQSEMVPVHEALGRVLGQGAVAEFAVPNHDNSAMDGYGIRHADLHPQDAVTLHVCADLPAGDRLSQAIGAGQAVRIMTGAPIPAGVDCVVMQEVVQRVGDQVTIPAGQALGQNIRPAGEDIAKGALYLNKGVRLTPAQLGLLTSMGQTSVAVFKRPRVAVLSTGNEVVRVGNPLRPGQVYDSNRTTLLTALQALGVEVVDLGLVRDDRAAIREALERGASQADAVISSGGVSVGDYDLVKAVLQELGQIDFWKVNMKPGKPQAYGTLGQARFFGLPGNPVSALAVFLLVVRPALLKMMGVAEYVPPLLRLPLLEGRLRKKNNRVDFQRGLIRYDAQQPGVVSTGGQGSGMLSSMAAADCFIVLPAEAVDYAPGELVTVQRIDY

SEQ ID NO: 18106 - protein, 610 aa, Zea mays
  unsure (1)..(610): unsure at all Xaa locations
MAQLVETYACSPATERGRGILLAGDPKTDTIAYCTGRSVIIRRLDAPLDTWVYPDHAYPTTVARFSPNGEXWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGGHTGSIYAVSWNPDSKQVLTVSADKSAKVWDIFEDASGKLNRTLVCPGIGGVDDMLVGCLWQNDHLVTVSLGGTFNVFSASNPDQEPVTFAGHLKTVSSLVFFPQXSPRTILSTSYDGVIMRWILGVGFGGRLMRKNNTQIKCFAAVEEELVTSGYDNKIFRIPLNGNQCGDAESVDVGGQPNALNLALQKPEFALVTTDSGIVLLHNSKVISTTKVNYTITSSSVSPDGTEAVVGAQDGKLRIYSISGDTLTEEALLEKHRGAITSIHYSPDVSMFASADANREAVVWDRASREIKLKNMLYHTARINSLAWSPDSRLVATGSLDTCAIVYEIDKPVASRVTIKGAHLGGVHGLTFLENDTLVTAGEDACIRVWKVVE

SEQ ID NO: 18107 - protein, 425 aa, Xylella fastidiosa 9a5c
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 18108 - protein, 416 aa, Zea mays
  unsure (1)..(416): unsure at all Xaa locations
MAAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVAAPPAENLNGKHEPKSPKAAPRSPKAATHSTFATSVKKPIGAKKVGGKTGGLGVRKLTTKPNESLYEQKPEEPKPAVPALAASTKKGGQALHSRFEYVENEPSADLRTGGSGSRVSGHVAPPKSSDFFQEYGMGNGFQKKSSNASKTQVEETDEARKKFSNAKAISSSQFFGTQNREEKEAQLSLQKFAGSSSISSADLFGRNDVDNSNLDLSAADLINRISFQASQDLSSLKDIAGETGKKLTSLASXFISDLDRIL

SEQ ID NO: 18109 - protein, 411 aa, Pyrobaculum aerophilum str. IM2
MRYLSGLNPIAKVVEILPQVKRISEVERVATWDVAGRVAARDVIAPHDYPPFPRAAYDGYAVSSDATPGRFRVIGTVLVGQYRRDLEVRGNEAVYVTVGAFLPEGADAVVPEEAVEREGEYVVVKAKYEKYANADAPGSYVRKGLVLLSQGTVVTPFDVVGLLDVGITTIYAYRRVKVGIIATGDELITPPIDPEVAAELVMRGKVIESTASLVTWYINTYMPYVSVEEKVVTSDKHEEVRAYVEKFLELYDAVIITGGAGPSEIDHFYKLGFGGLRGFRMKPGRPTSVAVVNGKPVFGLSGYPISALHGVIRIVEPVLRYMANVTKAPGLGWLYATITQDLHGEMAQIVRVKLEAGEGGLYAKPIKAKHHSFTEPEACGVALIPPGGVKKGDIVPVLAYRDVRRLGSAST

SEQ ID NO: 18110 - protein, 340 aa, Zea mays
MRPSLMRSTSQLLRRRSYSSASGQPERKVAILGAAGGIGQPLSLLMKLNPLVSSLSLYDIAGTPGVAADVSHINSPALVKGFMGDEQLGEALEGSDVVIIPAGVPRKPGMTRDDLFNINAGIVKNLSTAIAKYCPNALVNMISNPVNSTVPIAAEVFKKAGTYDEKKLFGVTTLDVVRAKTFYAGKANLPVTDVNVPVVGGHAGITILPLFSQATPATNALSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANDN

SEQ ID NO: 18111 - protein, 169 aa, Zea mays
MAPTVMMASSATAVAPFQGLKSTASLPVARRSSRSLGNVSNGGRIRCMQVWPAYGNKKFETLSYLPPLSTDDLLKQVDYLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 18112 - protein, 334 aa, Nostoc punctiforme
MTSKPERVVLIGVAGDSGCGKSTFLRRLIDLFGEDLMTVICLDDYHSLDRKQRKETGITALDPRANNFDLMYEQIKTLKSGQAIDKPIYNHETGLIDPPERVEPNHIIVVEGLHPLYDERVRSLIDFSVYFDISDEVKIAWKIQRDMAERGHRYEDVLAQINSRKPDFEKFIEPQREFADVVLQVLPTNLIKNDTERRVLRVRMLQREGKEGFDPTYLFDEGSTINWTPCGRKLTCSYPGMQLYYGSDVYYGRYVSVLEVDGQFDNLEEVIYIETHLSNTSTKYQGELTHLLLQHREYPGSNNGTGFFQVLTGLKMRAAYERLTATEAKLAVQV

SEQ ID NO: 18113 - protein, 472 aa, Zea mays
  unsure (1)..(472): unsure at all Xaa locations
MATHAALAASRIPAGARLIXHSRAAASSRHGVQRLDFADFSGLRPGSCSVSAAAREASFSDVLGAQLVAKVRMRFMDDATGENAVRAPAEAKLKVAINGFGRIGRNFLRCWHGREDSPIDVVVVNDXSGGVRNASHLLKYDSMLGTFKADVKIVDDTTISVDGKXSRVVSSRDPLKLPMGVSLXIDIVIEGXTGVFVDGPRRPGKHIPGPGAGRKVIITASRPRAPDIPTLWSVGVNRGXDTDHSVADIISNASXTTNCLAPFVKILGTREFGIXVRGTMTTTHSYTGDQRLLDASHRDLRRARAAALNIVPTSTGAAKAVXALVLPQLKGKLNGIALRVPTPNVSVVDLVINTXVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 18114 - protein, 353 aa, Aspergillus fumigatus
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTIFMQPAQIEGDSLPPEVGNAIGALWRDTGVQECFKRSREYQLNDSAKYYFDAIDRIAQPDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 18115 - protein, 175 aa, Lactobacillus delbrueckii subsp. lactis
MLYGDRSIENTDGTIRSLSNRHVQMIAIGGTIGTGLFLGAGTTISATGPSVIFIYAIMGLFFFFLLRALGEMFYFDSNSHTFVSFITRYLGEAAGRFAGWTYWIGILFACMAELTAVSTYVQYWLPGLPAWLIEVSVLGLLTLLNLTAAKLFGETEFWFAMIKIIAIISLVVTGI

SEQ ID NO: 18116 - protein, 335 aa, Pleurotus sajor-caju
MVNVGINGFGRIGRIVFRNALEVGGVDVVAINDPFIDLDYMVYMFKYDSVHGRFKGSIEAKDGKLIVEGKPIHIFAEKDPANIPWGSVGADYVVESTGVFTTIDKASAHLKGGEKVVISAPSADAPMFVCGVNLETYDPKYKVISNASSTTNCLTPLAKVIHDKFGIVEGLISTIHATTATQKTVDGPSHKDWRGGRSVNNNIIPSSTGAANWVGKVIPSLNGKLTGLSFRVPTLDVSVVDLVVRLEKPADYKEIVAAIKEASETTHKGILGFTSDSVVSTDFVGSTDSSIFDSTAGIQLNPNFVKLIAWYDNEYGYSRRVVDLLKYVAEKDGAQ

SEQ ID NO: 18117 - protein, 324 aa, Oryza sativa
MKWGLRSSRHNQREKQQRTQEEEHKHEQQEDKGNKSRAAFLSFSPLAWLSKLTAKNNAAAAKPKPAAPADKSAVAATGGFPSCFFKGASSSTSTSVSLSSSAASQSSLADSSPADHQAPRRLSVGNDGDTAEAAAARQLYHRRRHYSVGGDRDLQTLRNLIPFSRAASPIPVPAPFVPALKTTPPLLPSDTDEEKRPRSRRRRRRSGGGGRRSFSGRTPGARVAATVRVRSPRRVASAAAAAVSELERFAVVRRTSDPQREFRASMVEMIASKRIGRPEELETLLACYLSLNADEHHDCIVKVFRQVWFELNPARVAAVAPPRS

SEQ ID NO: 18118 - protein, 336 aa, Streptococcus agalactiae
MVVKVGINGFGRIGRLAFRRIQNVEGVEVTRINDLTDPNMLAHLLKYDTTQGRFDGTVEVKDGGFEVNGSFVKVSAEREPANIDWATDGVDIVLEATGFFASKAAAEQHIHANGAKKVVITAPGGNDVKTVVYNTNHDILDGTETVISGASCTTNCLAPMAKALQDNFGVKQGLMTTIHGYTGDQMVLDGPHRGGDLRRARAAAANIVPNSTGAAKAIGLVIPELNGKLDGAAQRVPVPTGSVTELVAVLEKDTSVEEINAAMKAAANDSYGYTEDAIVSSDIVGISYGSLFDATQTKVQTVDGNQLVKVVSWYDNEMSYTAQLVRTLEYFAKIAK

SEQ ID NO: 18119 - protein, 565 aa, Neurospora crassa
MASLKLLIINALKSLSRGRSFLQALLALWISPKSNPNKLKKIKVFRRTREEFLKEAKKLLLGPIGSNHFIKNSGPTPDDPLLLLSKKLEAQFRQGLQTSPACMLPSYNHQLPGGHESGQYLAVDIGGSTLRVGVVDLKGRQTTDDDDSTIVHMDSYKIDRNVRLLRGAFFFKWMARKVETSLKKAIDAGHISKAEYELGNPMPMGLAWSFPLEQTSPNGGNICPMGKSFLACDGLMGQDLGATCNKILQELRVNVEVVSIVNDSNATLLSSAYSSPSARFGLILGTGVNIAAHLPVNLIGKSKFGERPDSWYEQASHVMVNTELGMFGRDILPLTRWDKILKAGHERPDFQPLEHLVSGYYLGEVFRIALLEAIKTTGLLGGKIPPLLLDAYSMDTGTMSLIINGRDARGKAEAVFSQLYHLPAGYPSTEDMRFMQQLAGYIAQRSASIVAASVFALWELKNEAEQNVLNNLEPESPFSEETALELMMEQTTVGYTGSVLECFPGYKETLQRYLDQLMMSSGHDLKGRRIDLVPAKESSLLGAAVSLAGVVEEERMGLNEKKGIA

SEQ ID NO: 18120 - protein, 484 aa, Burkholderia fungorum
MMETETDLRRHDLLIDGKRLPPGTGEYSVDIDPATEEPIALVAQGSAADVDAAVHAARAALKVWNAIRSAERGRILMRLAGLMRANLEELAALESLDAGKPIAAVMRQDIPAAIDTLEYYAGWCDKINGQVVPVRPDALTYTLREPVGVVAAIVPWNFPLMIGMWKIAPALACGCTLIVKPAEITPLSALRIGELALEAGVPPGVLNIVTGKGRVVGDALVAHPGVDKVTFTGSPSVGRGILQGAAGNFKRVTLELGGKSANLIFPDANLDNAVRAAAAGIFFNTGQVCSAGSRILAHRDVYDEVVERLAARARSIKVGDPSSRETSMGPLISAAQMKTVLGYVETGRAEGASLVTGGARVGERGFFVEPTVFADVEHEMRISQEEIFGPVVSVIRFDDEADAIRIANGTLYSLAAGVWSADIGRVHRVARDLRAGTVWINTYGYTDVRLPWGGSGDSGFGREHGDVAIENFTEPKAVWLAIDQ

SEQ ID NO: 18121 - protein, 306 aa, Vibrio parahaemolyticus RIMD 2210633
MKPTAEILTDILAEVRPLIGQGKVADYIPALAKVPNNKLAIAVYTNEGEVIKAGDADESFSIQSISKALSLTLAMCLYKQEEIWARVGKEPSGQAFNSLIQLEMEQGIPRNPFINAGAIVVADLLQSRLSAPRQRLLEFVRQLSGDTHIVYDKVVAASEMMHGDRNAAIAYLMRSFGNFENEVIPVLQNYFHACALKMSCVDLAKTFSYLANKGTSVQTGKPVVSPTQTKQLNALLATCGLYDGAGEFAYRVGMPGKSGVGGGIIAVVPGEMTIAVWSPELDASGNSLAGTKALELLSERIGRSIF

SEQ ID NO: 18122 - protein, 205 aa, Halobacterium sp. NRC-1
MVDFQSRNTRRNDDDDDAAESSDDGTAESTPDNEDSTDAHHDDDVSQVGVAVVTVSSSRSLSDDPAGDAVVAAVEAAGHEVATRELVTDRYDRVQGALDNLTGRDDVAAVITTGGTGVTPDDVTVDAARPLFDMELPGFGEEFRRRSAADIGTKIIGSRATGGVVGGTLVFCLPGSEHAATLGTDEIILPELAHLAGLAGHNTDA

SEQ ID NO: 18123 - protein, 464 aa, Kappaphycus alvarezii
KMGYWDPQYVVKDTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 18124 - protein, 444 aa, Bacillus cereus ATCC 14579
MNQTLGAIDLTLLGIGAIIGTGIFVLTGIVAAKHAGPAIVLSFVLAAIICACVAFCYAEFASTVPVSGSVYSYTYMTLGEIFAFIVGWCVMLEYLLVTSAVAAGWSAYFQSLLLGFNIHIPTIFASAPGMGKGGIIDLPAVLIILVVTFLLSRGAKESARINNIMVIIKLAVIVGFIVVGTQYVRPENWQPFLPFGFHGVVGGAATVFFAFLGFDAVATAAEEVKRPQRNVPIGLLVSLFICTVLYVGVSFVLTGMVPFTELNVADPVAYALRTVGEDRIAGLLSVGAIAGLTTVLLVAMFAFVRVSYSMSRDGLLPKRLSSVHKRLQTPFFNTWVTGILAALLAGLVDLNLLANLVNMGTITAFVFVSIAVIVLRKTHPNMKRPFRAPLVPFLPIVSIVSCIYLALNLSKLTLISFVAWIIVGVFIYFVYAKKHSNVRNRNKV

SEQ ID NO: 18125 - protein, 432 aa, Lactobacillus gasseri
MSVITDIHAREVLDSRGNPTVEAEVYTELGGFGRAIVPSGASTGEHEAVELRDGDKSRFGGQGVLTAVENVNGEIAKAVIGLDVTDQRLIDQTMIDLDGTPNKGRLGANAILSVSLASARAAADELGLPLYEYLGGPNAHVLPTPMMNVINGGKHADNNVDIQEFMIMPVGAKSLHEAVRMGAETFHTLKGLLQERGESTAVGDEGGFAPNLKNNEEPFEILVEAIQRAGYKPGQDIAIAFDCAASEFYNKDTKKYVTVADGREYTAEEWTSLIEDLVDKYPVISVEDPLDENDWEGWKTFTERLGDKVQIVGDDLFVTNTSYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 18126 - protein, 95 aa, Gibberella zeae
TAGSWFCLDVAFYGLSLNNGTILKVIGYSTKDATNVYEFLHNTAVGNIIIVLAGAVPGYWVSVATIDTLGRKTIQLGGFIILTILFIVMGFAYNH

SEQ ID NO: 18127 - protein, 718 aa, Bacillus sp. 6.3.3
MFQMAKRAFLSTTLTLGLLAGSALPFLPASAAYADPDIAVTNKQSFSTDVIYQVFTDRFLDGNPSNNPTGAAYDATCSNLKLYCGGDWQGLINKINDNYFSDLGVTALWISQPVENIFATINYSGVTNTAYHGYWARDFKKTNPYFGTMADFQNLITTAHAKGIKIIIDFAPNHTSPAMETDTSFAENGKLYDNGTLVGGYTNDTNGYFHHNGGSDFSSLENGIYKNLYDLADFNHNNATIDKYFKDAIKLWLDMGVDGIRVDAVKHIALGWQKSWMSSIYVHKPVFTFGEWFLGSAASDADNTDFANKSGMSLLDFRFNSAVRNVFRDNTSNMYALDSMINSTATDYNQVNDQVTFIDNHDMDRFKTSAVNNRRLEQALAFTLTSRGVPAIYYGTEQYLTGNGDPDNRAKMPSFSKSTTAFNVISKLAPLRKSNPAIAYGSTQQRWINNDVYVYERKFGKSVAVVAVNRNLSTPANITGLSTSLPTGSYTDVLGGVLNGNNITSSNGSVNSFTLAAGATAVWQYTAAETTPTIGHVGPVMGKPGNVVTIDGRGFGSTKGTVYFGTTAVTGAAITSWEDTQIKVTIPSVAAGNYAVKVAANGVNSNAYNHFTILTGDQVTVRFVINNASTTLGQNIYLTGNVAELGNWSTGSTAIGPAFNQVIHQYPTWYYDVSVPAGKELEFKFFKKNGSTITWEGGSNHKFTTPASGTATVTVNWQ

SEQ ID NO: 18128 - protein, 377 aa, Thermoplasma acidophilum
MQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 18129 - protein, 256 aa, Zea mays
  unsure (1)..(256): unsure at all Xaa locations
MAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIXELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 18130 - protein, 169 aa, Zea mays
LEIGGEANLTAAIQVAQFALKNRQNKQLRQRIIVFVGSPVIDEKNWLEPEKLEALVAAVNSGGNSHIIHIPAGRDLSDALFSDSAAAARGASGFEFDVDPNVDPELALVLLISMEEERLRQEAAAKKAREESSKTENEGQSSTSNGDIVMADAEPEPNSYTEDKGLHCK

SEQ ID NO: 18131 - protein, 315 aa, Corynebacterium glutamicum ATCC 13032
MSLPIDEHVNAVKTVVVPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 18132 - protein, 303 aa, Methylobacillus flagellatus
MKLAIIGLGKMGGNMARRLLKHGIEVVGFDFNQDAVNQISLTNGMIPASSVEDAVSKLSGEPRKIVWIMLPSGDITENQIKDLVPLLSKGDIIVDGGNSNYKHSQRRGAWLAEHGIEFIDCGTSGGIWGLDNGYCLMYGGSKDAADAVVPIMQALAHADRGWAHVGPVGSGHFTKMIHNGIEYGMMQAFAEGLDLLKGKEEFNLDLAQITELWRHGSVVRSWLLDLTAEALAHDQELSAIAPYVADSGEGRWTVVEAVDQGVAAPVLTLALQMRFASQEDTGYSYKLLSMMRNAFGGHAVKTK

SEQ ID NO: 18133 - protein, 443 aa, Petroselinum crispum
MASIPVVQQNRVEAAGGGAVKQKNMAAVEGRNRRALGDIGNLVTGHGIEGKQQQIPQVSRPVTRGFCAQLLANAQAGVVENNKKQRAIVGDGVVAVRQKKVSVKPKPEDIIVISPDTEEADRVNKHLNRKKATEGSLKKKGQTFTSTLTARSKAAAFGLTRKPKEQIVDIDAADANNELAAVEYVEDMYKFYKLAEHESRVFDYIDFQPEINQKMRAILVDWLIEVHNKFELMPETLYLAINILDRYLSTESVARKELQLVGISSMLTASKYEEIWPPEVNDLTKISDNAYTNQQVLIMEKKILGQLEWNLTVPTPYVFLVRFIKASIPNEPAVENMACFLTELGMMNYATVTYCPSMVAASAVYGARCTLDKAPFWNETLKSHTGFSEEQLMECGRTLVRFHSCATENKLRVIYRKYSLDERGCVAMLPPAKALLTVAKPQT

SEQ ID NO: 18134 - protein, 365 aa, GIBBERELLA ZEAE PH-1
MAHTDVTEVDHTPTEHCEERNETGKPSKDLSASMAHIQIRQSSAEKHGWDEPVPESAPAVSFGHNLERNQESKMAGFPAGVVNIVNGCGAEAGSAITAHPGIDKIAFTGSTITGKTIMKKASETLKSVTLETGGKSPLIVFDDADFEQAVKWSNCGIMGLGNMGQICTATSRIFVQDTIYEKFLEAFHEQVKSSTVIGDPFDENTTHGPQVSKAQYEKILSLIESGKSEGAGLLTGGARSGDKGFYIQPTVFRDVKPNMKIVREEIFGPCFVIAPFSTEADAIERANDTEYGLGAAIFTENLRKAHRVAAGVQAGTVWIDSSQDTHWGVPFGGYKKSGIGRELGSYALSAYTQVKAVHATSQLYG

SEQ ID NO: 18135 - protein, 348 aa, Zea mays
MSSSTSGTREMSSPNSTATSIGQVQKVPGFAKLQGENFVYFMQTYSIMLGRTSRSYTADFDLSKYECGSQCVSRCHACIFYDFELRHFAIEVLGRNGCTIRGVSYLPGSVPIKLNSQDLIEIAGIKFYFLLPSRSIFATLAARDATMLPPQSPSLLHPNYPGNPSANDCGRSNGENGVKISNDMQGKLVKQKRSFSGELDISYSYGTKKNVDRVGTLDGCVNKLHIQIADKDTDNQQILLEEEKDVTTCLTTLISELSGPKEWVPMERLLSEIFKRFGKKWLRDRVSKYLPQKGMSGSSTKVDHRPWCSLWELLRKHPEHFVMTTLTRGEETLDYVGLVHLVSVENEP

SEQ ID NO: 18136 - protein, 488 aa, Geminocarpus austrogeorgiae
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAASGEIKGSYLNITAATMEQMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRKAATTCGPLKAALDLWKDITFDYTSTDTPDFVEVATESR

SEQ ID NO: 18137 - protein, 200 aa, Buchnera aphidicola
MANILLLDNIDSFTYNLVEQLRNQKNNVLVYRNTVSIDIIFNSLKKLTHPILMLSPGPSLPKHAGCMLNLIKKVKGDIPIVGICLGHQAIVEAYGGIIGYAGEIFHGKASLIRHDGLEMFEGVPQPLPVARYHSLICNKIPEKFVINSYFEKMIMSVRNNCDRVCGFQFHPESILTTHGDQILEKIIHWASLKYITNKKQ

SEQ ID NO: 18138 - protein, 426 aa, Caulobacter crescentus CB15 [sequence omitted]

SEQ ID NO: 18139 - protein, 223 aa, Oryza sativa
  unsure (1)..(223): unsure at all Xaa locations
WQEDLVCPRTLLQNVVWTSLYKWVEPVLGSRPMNKLRERALDRLMEHIHYEDENSQYLCLCPVNKALNMVCCWAEDPNSDAFKRHLARVPDFLWLSEDGMKAQVYDGCQSWETALIIQAFCATDLVNEYASTVQRAHEFMKNSQVVRNHPGDQSYWHXHRSKGSWTLSSADNGWAVSDTTAEALKGCIVGWTKISRXAWFGDPIXRERLYDAVDCLLILCDQD

SEQ ID NO: 18140 - protein, 190 aa, Arabidopsis thaliana
MDSRIFLAFSLCFLFTLPLISSAPNRFLTRSSNTRDGSVIKMKTSASSFGFDPTRVTQLSWTPRVFLYEGFLSDEECDHFIKLAKGKLEKSMVADNDSGESVESEVRTSSGMFLSKRQDDIVSNVEAKLAAWTFLPEENGESMQILHYENGQKYEPHFDYFHDQANLELGGHRIATVLMYLSNVEKGGET

SEQ ID NO: 18141 - protein, 350 aa, Zea mays
  unsure (1)..(350): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGPXLLNYPFSGGATFFILLSCSLAVFCNMSQYLCIGRFSATSFQVLGHMKTVCVLILGWILFDGPHPENILVGMLLAVMGMVVYSWGVEAEXAMEAEKKAAAPVPRIKSEMLDGEDVPLKARVSGVPAVDLEDGEMKS

SEQ ID NO: 18142 - protein, 279 aa, Pseudomonas aeruginosa
MIKKYLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTQMKGLGHAILTGRPLIGDEPFAVVLADDLCVNLEGDGVLTQMVKLYQKYRCTIVAVMEVNPTETNKYGVIAGDDIGDGLIRVRDMVEKPAPEDAPSNLAIIGRYILTPDIFKLIEETEPGKGGEIQITDALLKQAKDGCVIAYKFKGQRFDCGGAEGYIEATNFCYEHFYKTGKAY

SEQ ID NO: 18143 - protein, 431 aa, Oryza sativa
MVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRSLPYPSFCRTHRRVKRNVGPEAPPVIFIPYLPSPQPPPWPPNPPTSPPLPRVRGRGRRPRRRRFPPLSPRKSAPVNPSTTPRRRPTSPADSATSGLDPAFPSP

SEQ ID NO: 18144 - protein, 409 aa, Staphylococcus epidermidis ATCC 12228
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPIALDTTDTQEIIKTVKLIAPNYGGINLEDISAPRCFEIEETLKKETNIPIFHDDQHGTAIVTMAGLINALKIVDKELTNIKVVLNGSGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 18145 - protein, 155 aa, Ipomoea nil
MDLRLMGFDHPLFHHIMDYAGDDKSSNSSAPSRTFMLDAKAMAATPADVKEYPNSYVFIIDMPGLKSGDIKVQVDGDNVLSISGERKREAEEKEGAKYVRMERRVGKLMRKFVLPENANKEKITAVCQDGVLTVTVENVPPPEPKKPRTIEVKIG

SEQ ID NO: 18146 - protein, 484 aa, Xylella fastidiosa Temecula1
MHSNSCHFSDMKNGFFAICIFIALALLAGGNAIGRAEAQVQTNPLPSEQVTTELLMSEATPSDAVAIPKTTSPPVVDKGDVAWMLTSTLLVLLMVLPGLALFYGGMLRSKNVLSMMVQIGVVFSLIAILWVLYGYSLAFADGDMFIGTFNKAFLYGVDTATLVDTFSKGFKLPEYVYVAFQLTFAGITAALIVGAFAERVKFAAVLLFIFIWFSFGYLPLAHMVWSTPGFLLSKGALDFAGGTVVHINAGIAGLIGAYFVGKRIGFGQVAVKPHNVPMTFTGAALLWVGWFGFNAGSALEANSIAALAFINTMLATAAAILVWSLLEKMTKGKFSALGVASGMIAGLVGVTPAAGTVGPFGAIAIGAVAAVCCIWGITGLKRLLKVDDTLDVFGVHGIGGIVGAILTGVFTDKALGGQGYAEGMTMSNQVMIQAMSVGISIVWIGIVSLVGFLIVKLLFGLRVSEEAEREGLDITSHGESAYES

SEQ ID NO: 18147 - protein, 273 aa, Datura stramonium
MEESKVSMMNCNNEGRWSLKGTTALVTGGSKGIGYAIVEELAGLGARVYTCSRNEKELDECLEIWREKGLNVEGSVCDLLSRTERDKLMQTVAHVFDGKLNILVNNAGVVIHKEAKDFTEKDYNIIMGTNFEAAYHLSQIAYPLLKASQNGNVIFLSSIAGFSALPSVSLYSASKGAINQMTKSLACEWAKDNIRVNSVAPGVILTPLVETAIKKNPHQKEEIDNFIVKTPMGRAGKPQEVSALIAFLCFPAASYITGQIIWADGGFTANGGF

SEQ ID NO: 18148 - protein, 150 aa, Glycine max
  unsure (1)..(150): unsure at all Xaa locations
MSTYRDEDPRLHDIKTKIRVVPNFPKPGIEARGFIFGSPIALAIGAKFVPLRKPKKXLPGKVISQEYILEYGRDCLEMHVGAVEPGERALVVDDLIATGGTLCAAMDLLERVGAEVVECGCVIELPELKGRERLNGKPLHVLVECFECCQ

SEQ ID NO: 18149 - protein, 389 aa, Candida maltosa
MFDIKSIIRPNILTLEPYRCARDDFKTGILLDANENTHGPAIPTPDETELALELNRYPDPHQLELKQQVIDFREKHPNKYTKEKLSVENLCLGVGSDESIDMLLRCVCVPGKDKMLICPPTYGMYSICATVNDVVIEKVPLTVPDFQIDIPAILSKVKSDPNIKLLYLTSPGNPTGKLINVDSIITLLEELLNCWQGLIVVDEAYIDFTEPGSSMSTLVNQYPNLVVLQTLSKSFGLAGIRLGITFCSKELSWYLNAMKYPYNISSLTSNVALKATKQGLEIMENYVSKITEQRDIVLQKLLSLKYVGRNIGGLDSNFVLVEVLDKQGNPSNEVAKQLYNTLATGKSIVVRFRGSELNCVGGLRISIGTEEENKQLLEQFEAVLNDINQ

SEQ ID NO: 18150 - protein, 140 aa, Mesembryanthemum crystallinum
KKQFFRNFITIIVFGALGTLVSFTIISLGAMEFFKKLDIGSLELGDYLAIGAIFAATDSVCTLQVLHQDETPLLYSLVFGEGVVNDATSVVLFNAIQNFDLTHIDHRIAFKFAGNFLYLFFTSTLLGAITGLLSAYIIKK

SEQ ID NO: 18151 - protein, 265 aa, Glycine max
MAVESDKTGSVGKGWSFCSMPFWQTTHASSTSSTTTFSMHHSVHHQSQILQSLDRSTHQPSTTVSSVAKSLLPTRRRLRLDPPNKLYFPYEPGKQVRSAIAIKNTCKSHVAFKFQTTAPKSCYMRPPGGILAPGESIIATVFKFVEPPENNEKPIDQKSRVKFKIMSLKVKGEMDYVPELFDEQRDHVADEQILRVIFLDPERPSPALDKLKRQLAEAEAALEARKKPPEETGPRVAGEGLVIDEWKERRERYLARQQVEVVDSV

SEQ ID NO: 18152 - protein, 114 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 18153 - protein, 267 aa, Triticum aestivum
  unsure (1)..(267): unsure at all Xaa locations
MDMELDAAPDGFAKMGFGCKHYRRRCRIRAPCCNDVFHCRHCHNDSTKDGHELDRHAVESVICLVCDTEQPVAQVCSNCGVCMGEYFCRACKFFDDDVDKEQYHCKDCGICRVGGKDNFFHCHKCGSCYSVTLRDKHVCIEDSMKNNCPICYEYLFDSLREASVLRCGHTMHLQCFHDMLKHDKFTCPMCSVSIFDMEKFLRALDAEIEAKFLHMGKWRVFVGXQGWIVCNHCWDTTRVYPGMTGQRKCCHCQSYNTCRVAPSVLPA

SEQ ID NO: 18154 - protein, 521 aa, Arabidopsis thaliana
MADQQLGVLKALDVAKTQLYHFTAIVIAGMGFFTDAYDLFCVSLVTKLLGRLYYFNPTSAKPGSLPPHVAAAVNGVALCGTLAGQLFFGWLGDKLGRKKVYGITLIMMILCSVASGLSLGNSAKGVMTTLCFFRFWLGFGIGGDYPLSATIMSEYANKKTRGAFIAAVFAMQGVGILAGGFVALAVSSIFDKKFPSPTYEQDRFLSTPPQADYIWRIIVMFGALPAALTYYWRMKMPETARYTALVAKNIKQATADMSKVLQTDLELEERVEDDVKDPKKNYGLFSKEFLRRHGLHLLGTTSTWFLLDIAFYSQNLFQKDIFSAIGWIPKAATMNAIHEVFKIARAQTLIALCSTVPGYWFTVAFIDIIGRFAIQLMGFFMMTVFMFAIAFPYNHWILPDNRIGFVVMYSLTFFFANFGPNATTFIVPAEIFPARLRSTCHGISAATGKAGAIVGAFGFLYAAQPQDKTKTDAGYPPGIGVKNSLIMLGVINFVGMLFTFLVPEPKGKSLEELSGEAEVDK

SEQ ID NO: 18155 - protein, 683 aa, Chlamydomonas reinhardtii
MKALRSGTAVARGQAGCVSPAPRPVPMSSQAMIPSTSSPAARAPARSGRRALAVSAKLADGSRRMQSEEVRRAKEVAQAALAKDSPADWVDRYGSEPRKGADILVQALEREGVDSVFAYPGGASMEIHQALTRSDRITNVLCRHEQGEIFAAEGYAKAAGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWEAPMSITGYISRLPPPVEESQVLPVLRALQGAAKPVIYYGGGCLDAQAELREFAARTGIPLASTFMGLGVVPSTDPNHLQMLGMHGTVFANYAVDQADLLVALGVRFDDRVTGKLDAFAARARIVHIDIDAAEISKNKTAHVPVCGDVKQALSHLNRLLAAEPLPADKWAGWRAELAAKRAEFPMRYPQRDDAIVPQHAIQVLGEETQGEAIITTGVGQHQMWAAQWYPYKETRRWISSGGLGSMGFGLPAALGAAVAFDGKNGRPKKTVVDIDGDGSFLMNVQELATIFIEKLDVKVMLLNNQHLGMVVQWEDRFYKANRAHTYLGKRESEWHATQDEEDIYPNFVNMAQAFGVPSRRVIVKEQLRGAIRTMLDTPGPYLLEVMVPHIEHVLPMIPGGASFKDIITEGDGTVKY

SEQ ID NO: 18156 - protein, 546 aa, Triticum aestivum; identical to SEQ ID NO: 4346

SEQ ID NO: 18157 - protein, 459 aa, Rhodococcus sp. Phi2
MGVYTTTDPATGEEVAQYPEISDAQLDELIGRSAAAYRSWRTTPLEQRRAVLSRAAEIHREQADELAALLTLEMGKPITQAKGEVALVASIYQYYADHAEEFMADEPLDIAGSGTAVVRTEAIGPLVGVMPWNYPYYQVARFAAPNIALGNTIILKHARNCPQSALAIERVLTEAGLPDGVYLNAFISSAQVAAAIADPRVQGVSLTGSEKAGSAVGEVAGRHMKKCVLELGGSDPFIVLGDADVDAAAAAAVVGRLGNGGQACTASKRFLVEEPVYDEFVRKFLDGMISWQPSDPTSPETKLGPLSSRSAVDELDELVQDAVSRGAQVLTGGDPRDEKGAYYPPTVLVGVTPDMRAYYEELFGPVAVVHRVGSLDEAIEAANDSPFGLSSSVFTSDPQKADRVAEELETGMVWINSTSKSSPDLPFGGVKRSGVGRELARFGFDEFANKKLVRKPGKK

SEQ ID NO: 18158 - protein, 780 aa, Oryza sativa (japonica cultivar-group)
MTQADQAVISLRPGGGGGIGGPRAGRLFPFGASTGSLDFLRPRGGASSGFAAKLGDLRFEPLERVRYTRDQLVELHEIIDIPENILKLKQDIDIELHGEDEPWINNDSSVQTQSYNRYAETDNRDWRSRIEQPVQTPAIGGEEKSWDKFREAKESYISSGKQDQFNNQDKLSSQFSAKAQVGPAPALVKAEVPWSIQRGNLSNKERVLKTVKGILNKLTPEKFDLLKGQLIEAGITTADILKDVISLIFEKAVLEPTFCPMYAQLCFDLNEKLPSFPSEEPGGKEITFKRVLLNNCQEAFEGADNLRSEVNKLTGLDQEMERRDKERLVKLRTLGNIRLVGELLKQKMVPEKIVHHIVQELLGSESNRCPAEENVEAICQFFNTIGKQLDENPKSRRFNDVYFNRLKDLTTNSQLASRLRFMARDVLDLRSNQWVPRREEMKAKKISEIHREAENNLGLRPGSTASIRTGRTGTGGGGPLSPGAFSMNQPGIVGMLPGMPGARKMPGMPGLGSDDWEVPHSRSKPRADPVRNLTPSLANKPSPNNSRLLPQGSAALISGKTSALVGSGGPLSHGLVVTPSQTTGPPKSLIPAPSVDPIVEQPAAAPKPSSTELQKKTISLLKEYFHILLLHEAQQCIEELKSPDYYPEVVKEAINLALDKGTNSIDPLLRLLEHLYNKNVFKATDLETGCLLYSSLLDELAIDLPKAPVHFGEVIGRLVLSHCLSIEVVEDTLKKIEDSFFRAAVFEAMMKIMKANPSGQAILGSHVAKIDACSKLLSSE

SEQ ID NO: 18159 - protein, 275 aa, Oryza sativa
SCQTPPYDKWVPLEPTVRPPTQTRSPLAPKISTSLDLSRRKRPSAPASPRPFHHLSEPSTPFQTPPPRHPYLNPSSHRAIKRQDREATNPSAIRGRRRRRRRRRRGDREMESAMFGLETPLMTALQHLLDIPDGEGGAAGKQGATGGPTRAYVRDARAMAATPADVKDLPGAYAFVVDMPGLKSSDIKVQVEEERLLVISGERRRGGGEEEKEESCKYLRMERRMGKFMRKFVLPDNADVDKISAVCQDGVLTVTVEKLPPPEPKKPKTIEVKVA

SEQ ID NO: 18160 - protein, 610 aa, Zea mays; identical to SEQ ID NO: 3176

SEQ ID NO: 18161 - protein, 157 aa, Staphylococcus aureus
GHSERRELFHETDEEINKKAHAIFKHGMTPIICVGETDEERESGKVNDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGA

SEQ ID NO: 18162 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 18163 - protein, 122 aa, Zea mays
MQAVGIRRRGLTIDPAGEEEAPAARVGRLVRESPVVIFARRGCCMAHVMRRLLAAVGAHATVIELGGAAEEEELAAAEGGGGGGVPALFVGGDPVGGLEGLMRLHLSGRLVPRLRELGALCA

SEQ ID NO: 18164 - protein, 466 aa, Shigella flexneri 2a str. 2457T
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDPWLTWLVIGFITFVLVVMLFRPAQQLEVISTGLLAIGIICTVPIMARWKKLVLWQKTPVHNTR

SEQ ID NO: 18165 - protein, 260 aa, Thermococcus sp. KS-1
MAFVPPQAGYDRAITVFSPDGRLFQVNYAREAVKRGATAVGVKWKDGVVLAVEKRITSKLIEPSSYEKIFLIDDHIAAAPSGIIADARVLVDRARLEAQIYRLTYGEPVPLTVLVKKICDLKQAHTQYGGVRPFGAALLMAGVNEKPELFETDPSGAYFEWKAVAIGSGRNTAMAIFEEHYRDDIGKDDAIKLAILALAKTLEEPTAEGIEVAYITMDEKRWKKLPREELEKYLNEILQEVKEEEVEEKQEDYSELDQNY

SEQ ID NO: 18166 - protein, 298 aa, Synechocystis sp. WH 8501
MKQLSSLSSAQLSNWLMEASQEAKKGKLADYIPLLQRTDSSLLFICVVTKNNIFLTQGDSKITFSLMSIIKPFLLLYLLSELGDNFIFTKVGSEHSNYPFNSLDQLQLDQGFPRNPMINSGALTLASLLPGKDSHTRLNNLQEWLNKQSNANLFLDKLMLKSVESLPNLRNQSIIDNLTQRKHLKEPEITLDTYNKICCLSATIIDLAKLGLLLVNSPNISSKNVSIVTEIMTTCGLYEASENFAKKIGFPSKSGVSGAILSIVPKEGAIACYSPPLDAQGNSLGGLYMLQKIANYLN

SEQ ID NO: 18167 - protein, 236 aa, Zea mays; identical to SEQ ID NO: 5704

SEQ ID NO: 18168 - protein, 438 aa, Cryphonectria parasitica
MPISKIHARYVYDSRGNPTVEVDLVTETGLHRAIVPSGASTGQHEACELRDGDKSKWLGKGVLKAVENVNTVLGPELIKAGLDVKDQTAVDEFLIKLDGTANKTKLGANAILGVSLAVAKAGAAEKGVPLYAHVSDLAGTKKPYVLPVPFQNVLNGGSHAGGRLAFQEFMIVPSAAPSFSEGLRWGAETYHQLKSLAKKKYGQSAGNVGDEGGVAPDIQTAEEALELISEAIEKAGYTGKMKIAMDVASSEFYKEDVKKYDLDFKNPDSDPSNWLTYEQLAALYADLTKKYPIVSIEDPFAEDDWEAWSYFYKTQDIQLVADDLTVTNPIRIKKAIELKAANALLLKVNQIGTLTESIQAAKDSYADGWGVMVSHRSGETEDVTIADIVVGIRAGQIKTGAPARSERLAKLNQILRIEEELGSNAIYAGEDFRKSVTL

SEQ ID NO: 18169 - protein, 472 aa, Hypnea musciformis
ESGVIPYAKMGYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIISERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMAIWARKNDMILHLHRAGNSTYSRQKIHGMNFRVICKWMRMSGVDHIHAGTVVGKLEGDPLMIKGFYNTLLLPYLEVNLLQGIFFEQDWASLRKVTPVASGGIHCGQMHQLLDYLGIDVVLQFGGGTIGHPDGIQAGATANRVALESMVMARNEGRDYVAEGPQILQDAAKTCGPLQTALDLWKDITFNYTSTDTADFVETPTANV

SEQ ID NO: 18170 - protein, 234 aa, Hordeum vulgare subsp. vulgare
MATIYDIGLGAGFNILMATIFLLIFAFLRLQPINDRIFFPKWYLKGMRDSPSSAGAAVTKYVNLNVRSYLKFLSWMPAALKMPEEELIEHAGLDSVVYLRIYLTGLKIFVPITILAFAVLVPVNWTNDTLEGLKVVHSDIDKLSISNIPYGSKRFIAHLVMAYVFTFWTCYVLKNEYERVATMRLRFLASEKRRPDQFTVLVRNIPPDPDESVSELVEHFFLVNHPDHYLKHQV

SEQ ID NO: 18171 - protein, 214 aa, Listeria monocytogenes EGD-e
MTFVAPSLLAADYMNMANSIKEAEDAGADYLHIDVMDGHFVPNLTFGIDMVEQIGKTATIPLDVHLMLSNPENYIEKFAAAGAHIISVHIEAAPHIHRVIQQIKAAGCKAGVVLNPGTPASVLDAVLADVDLVLQMTVNPGFGGQAFIDSTIKNMRYLDNWRRKNHGSYVIEVDGGVNAETAEKCKQAGVDILVAGSYFFGATDKAACIQGLKK

SEQ ID NO: 18172 - protein, 402 aa, Pseudomonas putida KT2440
MANPGSPRRFARIDRLPPYVFNITAELKMAARRRGEDIIDLSMGNPDGATPPHIVEKLVQVAQREDTHGYSTSRGIPRLRRAISNWYKDRYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNLLVKGLHELGWMVENPKASMYVWAKIPPEYAHLGSLEFSKKLLAETKVCVSPGIGFGDYGDDHVRFALIENQDRIRQAIRGIRQMFRADGLARK

SEQ ID NO: 18173 - protein, 154 aa, Glycine max
  unsure (1)..(154): unsure at all Xaa locations
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDXGVSIGTIFGVYALKDVHEPTIED

SEQ ID NO: 18174 - protein, 392 aa, Synechococcus sp. PCC 7942
MPNFRLSQRLAPLQRNVFADMDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAGGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 18175 - protein, 359 aa, Candida rugosa
MSKSIVLLPGDHVGTEVVAEAVKVLKAIERTTPGTSFSFSTHLIGGAAIDATGVPLPDEALEAAKASDAVLLGAVGGPKWGTGDVRPEQGLLKIRKELGLYANLRPCSFASSKLVDLSPLKREIVEGTDFVVVRELVGGIYFGERKEDDGSGVASDTETYSVPEVERITRMAAFLALQHNPPQTVWSLDKANVLASSRLWRKTVTRVMTEEFPTVPFQHQLIDSAAMILVQKPTKLNGVVLTSNMFGDIISDEASVIPGSLGLLPSASLASLPDTNTAFGLYEPCHGSAPDLPAGKVNPLACILSAAMMLRLSLDNAAAADRIEQAVREVIDSGVATADLGGSSSTGEVGDAIVKALEK

SEQ ID NO: 18176 - protein, 481 aa, Glycine max
  unsure (1)..(481): unsure at all Xaa locations
PSSSLESSTAMTTATEKLSALKSAVAGLNEISESEKNGFISLVSRYLSGEAQHVEWSKIQTPTDEVVVPYDTLAPTPDGSSDVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVAEDFLPLPSKGHTDKDGWYPPGHGDVFPSLLNSGKLDALLSQGKEYVFVANSDNLGAIVDLKILNHLIQNKNEYCMEVTPKXTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKISIVANPGVKLEVPDGAVISDKEINGPEDLL

SEQ ID NO: 18177 - protein, 469 aa, Porphyra rosengurtii
  unsure (1)..(469): unsure at all Xaa locations
VIRYAKMGYWDADYVIKEPDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYXXXXXXXXXXXYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 18178 - protein, 442 aa, Pseudomonas aeruginosa PAO1
MTLRKIAGLGALLSLALPGVALAAEEPVLNSGDTAWMLISTALVLLMTIPGLALFYGGMVRAKNVLSIMMQCFAITGLITILWVVYGYSLAFDTAGMEKGVLNFNSFVGGLDKAFLSGLTADGLTSATALFPESVFITFQMTFAIITPALIVGAFAERMKFSAMLIFMAVWFTVVYAPIAHMVWSGDGALMWDWGVLDFAGGTVVHINAGIAGLVACLVLGKRKGYPTTPMAPHNLGYTLVGAAMLWIGWFGFNAGSAAAANGTAGMAMLVTQIATAAAALAWMFAEWITHGKPSALGIASGVVAGLVAITPAAGTAGPMGALVIGLASGVICFFAATSLKRALKYDDSLDAFGVHAVGGIVGALLTGIFAAPSLGGFGSVEDIGAQFFVQFKGVAFTVVYTAVVTFVILKVLDLVMGLRVTEEEEAVGLDLALHNERGYNL

SEQ ID NO: 18179 - protein, 388 aa, Microbulbifer degradans 2-40
MEGGVFESFFLIFCGAAVVASVALYTRQPLLVAYIAVGAILGPFGLEIIKDVHYVAEMSHIGIIFLLFLLGLDMQPSALLNVLKKATSIALISSAIFGALGYGFGVIIGFSHMESLVLAMASMFSSTIIGIKLLPTTVLHHKHSGDLMVGLLLFQDFIAILCLLVLLSGGGDTVEPMKLIKAIAALPLLAAGAFLFVRFVLLKLIQKFDRFHEYIFLLAIGWCLGLAHLSESVNLSAEIGAFIAGISLATSPISQYIALNLRPLRDFFLVLFFFALGAQLNIPLLPSVLLPALIFAAVVLAAKPTVFFLLLKQQSEKTSLAWDLGFRLGQISEFSILIVFVAATNNLIGEQASLLIQTTAILTFIVSSYIVIFNFPNPIAVSDKLRRD

SEQ ID NO: 18180 - protein, 595 aa, Oryza sativa
MVEHGKQLAIPAKVMPLDNAVFTEVEADELSCHGTPAHCAEHGQASLVLKDDQECSASHVHGNGPVEESNGCMPNQRIDEHGQIDFGHSLQLVLFSRQWGLAESLVALADHQLMLDYGLSVALDAIWFLRTEQDLQGLNHLIGKIVESGAKDFARAILRTSLLASCVVACQSKALTLGDSKEIIAQRLHDRLQDCPGGERLQIEAGAKVQKFIEWALQCIHLHRCSEDTECYKANCSTHQEVQFHLSAFKAFLDIAGDNLSGKIFTEAFDAACFPLTLFSTLFEPGWSSGSSAVAIQGLLSLLVEGGAENVNQCFLEASRFGSTELVRILLKIAHQNSLAVDVDLALVYASHYCKFETMACLVDEGHATSFLCPLVKAFERGCLQVVQWFATRLVSDIEMCLAVTTAASCGHFAVATYLLAHIPRHVLEALSPQILKAARGQGSGSFEGVSFLLRSNFLNDAAATYAVADSIATTSTMDIPQDLVDFLKEQWSQAAFAEGVEAGEDHFVNITRVLRRGASPIRLHDLPEPMALAIAYLPLYRACASARGQLLPQRLRGELVEAVGRLGVPVNMENNRRDFLAVLEHYFPSFITGA

SEQ ID NO: 18181 - protein, 466 aa, Amycolatopsis mediterranei
MPTTPDDIQRLIADEDVEVIDVQFCDLPGVMQHFTVPAKAFTEEAYEEGLAFDGSSVRGFQSIHESDMLLLPDAATARIDPFRKAKTLALNFFVHDPFTREAYSRDPRNIARKAEQYIAEYGVADNVYFGPEAEFYIFDSIRFDSAEHASFHEIDSVEGWWNTGADEVGGNQGYKTKFKGGYFPVPPVDHFADLRDDIVRNLQGSGFEIERAHHEVGTAGQTEINYKFNTLLHAADDLQLFKYIVKNTVFAAGKTATFMPKPLAGDNGSGMHCHQSLWKDGQPLFHDESGYAGLSDTARHYIGGLLKHAPSLLAFTNPTVNSYHRLVPGFEAPVSLVYSQRNRSACVRIPITGNNPKAKRAEFRCPDSSGNPYLAFSAMMMAGLDGIRNKIEPPEPIDKDLYELPPEEAKDVKLVPGDLGTVLNTLEGGVFTPDVIETWISYKRENEIDPLRLRPHPYEFSLYYDV

SEQ ID NO: 18182 - protein, 486 aa, Bacteroides fragilis
MENKKLTAANGRPIADNQNSQTAGPRGPIMLQDPWLIEKLAHFDREVIPERRMHAKGSGAYGTFTVTHDITKYTRAAIFSQVGKQTECFVRFSTVAGERGAADAERDIRGFAMKFYTEEGNWDLVGNNTPVFFLRDPLKFPDLNHAVKRDPRNNMRSANNNWDFWTLLPEALHQVTITMSPRGIPASYRHMHGFGSHTYSFLNAENKRIWVKFHLKTMQGIKNLTDQEAEAIIAKDRESHQRDLYESIERGDFPKWKFQIQLMTEEEADNYRINPFDLTKVWPHKDFPLQDVGILELNRNPENYFAEVEQSAFNPMNIVEGIGFSPDKMLQGRLFSYGDAQRYRLGVNSEQIPVNKPRCPFHAFHRDGAMRVDGNYGSAKGYEPNSYGEWQDSPEKKEPPLKVHGDVFNYNEREYDDDYYSQPGDLFRLMPADEQQLLFENTARAMGDAELFIKQRHVRNCYKADPAYGTGVAQALGIDLEEALKE

SEQ ID NO: 18183 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 18184 - protein, 268 aa, Xylella fastidiosa Dixon
MSNSKVVVITGVSSGIGRATALILAKQGCQVFGTVRNAEKAQAIPGVVLVEMDIRDDVSVERGIQNIIAQAKRIDVLVNNAGVTLLGATEETSVTEAKTLFDTNLFGMLRTIKAVLPHMRGQRSGRIVNISSVLGFLPAPYMALYSASKHAVEGLSETLDHEVRQFGIRVALVEPSFTKTNMDLNAPQTASKIPDYSREFDIVSKAIQKNVQKAPDPEGVASTILNAALGRWKMRHTPKGQASCLAKLRRFMPAGPVEKGLRKTFGLG

SEQ ID NO: 18185 - protein, 559 aa, Methanosarcina mazei Goe1
MENNLQGVLKGQKIAYFSMEIGLRNEIPTYSGGLGVLAGDTIRSAADLNIPLVAVTLVSNKGYFRQKLDASGTQTELTEEWTPSNFMTWLPQEVSVKIQGRDVKIQAWHYNCKSLTGGCVPIIFLDTNVEGNSPEDRRITDFLYGGDHTYRLKQEIVLGVGGVRMLNALGFKIRKYHMNEGHSSLLALELLKCNGKECPIVKDLCIFTTHTPVEAGHDKFDYSLVEDMIRDQNDMEILKKYGGEDRFNTSLFALNLSDYVNGVTKRHSRVSSELFPGYSIQAITNGVHSYTWTCPYFRDLFDRYMPGWANEPELLVRIGGIPDDEIWEARRKAKKALIDEVNKRTGAGMEYETFTIGFARRMTAYKRATLLLSDIERLRKVNRRGKIQIIFAGKAHPRDEAGKQLIRDIFKSIETLRNEVKIVFLENYDMDLAAKMVSGVDLWLNTPTRPYEASGTSGMKAAHNGVVNFSILDGWWIEGWIEGVTGWSIGPMPEENLIGEEARVAELNDLYNKLYYIIVPMYYERKDDWLKMMNNSIGMIAYYFNSHRMMRRYVTHAYL

SEQ ID NO: 18186 - protein, 452 aa, Oryza sativa
  unsure (1)..(452): unsure at all Xaa locations
MGEESSPAAAPAVEVLSYFVCPISLEIMRDPVTLSTGITYDRESIERWVFTDGHGECPVTKQRLAPADREPTPNHTLRRLIQGWCAVHAVERFPTPRPPVDAARVAAIVDAARPLLRRRRQREELMASLRELADIVAESDRNRRCVQGASGAVEFLLSVVKERASVAGVDDATSAKPEETTCGGVHDPAKASSPEEAALSILHSLKLSEESFKRVLEGSGGEDFLETMACVLRRPSYLSRMQGIHLLKSALPAMAPARLTSARAALVDGVVGVVADRPSAKAVKVALHVLCRLCPWGRNRVKAVDAGAVSALVRLLLDEGCGGGGGDRRACELAAVAIDHICRLRGGAPGSGGAPGGAQRQVACAATRXCPHTAGAESAVRALHAVARHSATSAVLQEMLPVGVVARLLFLVQVGASGERTRARAREMLKMHARVWRDSPCLASHLNASYPR

SEQ ID NO: 18187 - protein, 476 aa, Ptilophora hildebrandtii
NERYESGVIPYAKMGYWDPDYVVKETDVLALFRITPQPGVDAVEASAAVAGESSTATWTVVWTDLLTACDLYRAKAYKVDPVPNTSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAGTGEVKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIRGFYNTLLLPHLDVNLPQGIFFEQDWASLRKVTPVASGGIHCGQMHQLLDYLGEDVVLQFGGGTIGHPDGIQAGATANRVALEAIVIARNEGRDYVAEGPQILRDAAKTCGPLQTALDLWKDITFNYTSTDTADFVETPTANV

SEQ ID NO: 18188 - protein, 460 aa, ASPERGILLUS NIDULANS FGSC A4
MGNQQSNIGGGHDGKDDKDKKKDKPKYEPPPPPTTRIGRKKRKAAGPSTASKLPDIFPTSRCKLRYLRMQRVHDHLLLEEEYVENMERLRKAKASASDSANRGDVDITDRNADERSRVDDMRGSPMGVGNLEELIDDDHAIVSSATGPEYYVSIMSFVDKDLLEPGASILLHHKTVSVVGVLTEESDPLVSVMKLDKAPTESYADIGGLESQIQEVRESVELPLLHPELYEEMGIKPPKGVILYGAPGTGKTLLAKAVANQTSATFLRIVGSELIQKYLGDGPRLVRQIFQVAAEHAPSIVFIDEIDAIGTKRYDSTSGGEREIQRTMLELLNQLDGFDDRGDVKVIMATNKIETLDPALIRPGRIDRKILFENPDQNTKKKIFTLHTSKMSLGDDVDLDEFINQKDDLSGADIRAICTEAGLMALRERRMRVQMDDFRAARERIMKTKQDGGPVEGLYL

SEQ ID NO: 18189 - protein, 2358 aa, Schizosaccharomyces pombe
MRNKNILVLNLILSIPRLVFTAKYDERESLWNLNQNQSATDPLDYWGKWENHQYHPSPDDWQVPFYTVILDKWKDGDPRNNEANNTIYEYDIYETGFRNGGDIIGLKDSLDYLEIMGIKVIYIAGTPFLNQPWGADQYSPLDYTILDHHSGTIAQWRDTIEEIHRRGFYLVLDLTISTLGDLIGFRKYLNSTTPFSLFEHEAVWKSNVIYPDWNFTNKYDPKCELPRFWGEDGAPVVIDYVGCYDSDFDQYGDTEAFGTHPDWERQLSKFASVQDRLREWRPSVSEKLKHFACMIIAMLDVDGFRIDKATQITVDFLASWAHSVRGCAATFNKKNFFIPGEVTGSSSYGSIYYGRGRQPDQRPPSILTSLNSSSLKENYFLREPKANALDASAFHYSLYRAMTRFLQMDGDLQVGHDLPVDFTDLWNAMAVNEDFYNPNTHKVDPRHMLGITNHDVFRWSAIEFGLERLLLGTMITYFLFPGAPSIYYGDEQGFYVLDNTANNYLYGRQAMPSSIAWKVHGCYALASDQYPELPVIKAYQGCNDDWNIMDHFDFAKPELKMFKIFNFIREQYPALKSGWKSVKLRNWTEYVHFPNSGKTPTEVGVWSIVRGALETLQNFDARNNTAWNGDIWILYTNQNRTTTLDYQCSSSNSVVSPYASGLTLKNLIYPFEEYILQESNKYSSNLKSYYGCIPNIEFPPWGFKILIPKKYYVRYPPQITSFNPQHDSRIYNHNGKQKLVISFTETMDCNEITSKLQFSSKTESGKVMKVDKETVKCSVSNNSADSYYFGLAPARFHWSGDLINIADGIHEIKLQRVHSQDHQSMSDSMYKLLLRFGKLDNPMVFSTANRSSSILSQENEKLYINHKAPGADLFRFSFDYGLHWSEWIDYLSNKTECTEFANNISLKTWKGHHVIVQYWSRLTASANYIQEGGLGSLSSFPHLYMNGPYNQWGFDSGIPNRLIYKNCSWHKTFISDVFPTKFQFNVYNFDESGMPDQKKVYGTIGNSTVLVRLPPSELKESVTWIKEAPPSNFLTWEIIISDLTRTYHLIPRGSSTVSIILFSLFLVSPLICALATMLAFQKFFYQVRLNKGIEKKQEWKEKLLGPFSRISQSNINQGFSHQVALNNSVKSVHPKISRKLILVATLEYDIPDWDIKIKIGGLGVMAELMGKHLTHHDLIWVVPRVGDVNYPDGQELAPLEVVVLDQVYEVRVYSHNLRNITYILLEAPVFRKQTSAEPYPARMDDLSSAIFYSAWNQCIAGIIRRYPIDVYHINDYHGALAPCYLLPNVIPCVLSLHNAEFQGLWPLRTQAEKNEVCAVYNISTKICTKYIQFGNVFNLLHAGVSYIRIHQKGYGVVGVSNKYGKRSKARYPIFWGLKKVGKLPNPDPLDTAQLDDPTNITEEITIDLTAEAEKRAFKRDAQKWTNLELDDSADLLVFVGRWSMQKGIDLIADIAPTLLQDFNAQLITIGPIIDLYGKFAAEKLNALMKKYPKRVYCRPEFTHLPPCIFSGADFVLIPSRDEPFGLVAVEFGRKGALGIGARVGGLGQMPGWWYSVESNATSHVLQQFEEACRKALSSSAEKRALLRAKSAKQRFPVLEWISKLDHLMDNCIRLNVGQRQQGSSSHSMKFRSKNDLSSIKLSTKEGLENEENELKDKAPPNEPNVGSLFLFNKSSMGSVGGPGHYKATDLSQELETNDQDIEYNEFYSQLDTSTSDIFQDTSVDGFPDLQVSSDINVRNDRLSSFVMSSEDLRSSDGHPENSDSVLETISSVHHRSPINQVVRNLNESQLSLDSVISMNLNKEFALTKTENDFTDDNGRALNYFSQKLEELDPKNSVNELCIETFILKMKKEWYDGLRNIRFGIQRPNLLIYDEDKKFINTEHFLGSKVNLNSVTSLGNFNGSSPNSFLFLLKNRTMRIKCFMQMRIGDWPVYSIFLSVGQILAATSYQLVLLSGSSAQFSTQLYIVGSIYTVSSVFWWYLYRMLPSVASLSLPFLLYCASFLLIGISSFINENMYLRLWISHIASWIYAVASASGSLYFSLNFGDEAGAGVVSWIVRACIVQGFQQIWACCLWYWGSYIDRSMQECHSFPHEVYPLGLIAVFSWPLALVMLLFAILLIFGLPDYYWESPGNIPAFYTALLRRKLVLWFFVATILQNYWLSTLYGRSWKYLWGGSLLAPWKMLTIAFFLFLSMWIIMLMFLGRKSLTHSWLLPVFGVGLGSPRWLQMMWGTSNIGVYLPWAGVAGPIVGRILWIWLGVLDSVQGVGVGMILLQTLTRRHIATTLIAGQIIGTLTSMLARATAPNRLGPGLVFLDLTSWRFEDGAKIFRSAPFWICLISQIAVSAGYLLFFRRENLSRP

SEQ ID NO: 18190 - protein, 178 aa, Zea mays; identical to SEQ ID NO: 3538

SEQ ID NO: 18191 - protein, 464 aa, Saccharomyces cerevisiae
MGQILSNPVIDKESHSGADSLTAFGLCAMQGWRMSMEDSHILEPNVLTKSDKDHIAFYGIFDGHGGAKVAEYCGNKIVEILQEQKSFHEGNLPRALIDTFINTDVKLLQDPVMKEDHSGCTATSILVSKSQNLLVCGNAGDSRTVLATDGNAKALSYDHKPTLASEKSRIVAADGFVEMDRVNGNLALSRAIGDFEFKSNPKLGPEEQIVTCVPDILEHSLDYDRDEFVILACDGIWDCLTSQDCVDLVHLGLREGKTLNEISSRIIDVCCAPTTEGTGIGCDNMSIVVVALLKEGEDVAQWSDRMKSKAHRTSVRSFADKRRRVFSYYDFSKCNDEQVFAITTKKPQDKFTRDHEAAVASVTAADNDDPMDIDDTDADTDAENLDPSSQSKSKTSGPIDLASLEALLGATGGVKTDSNGNKVTYTLPQSALAQLLQTMGHDPASSHPENDSNTDHKAGRSHLQ

SEQ ID NO: 18192 - protein, 492 aa, Brucella suis 1330
MQDKIDRLRQQAVPPQSLFINGRWQPAADGNVMAVISPIDGTQLTTIAAATAIDVDRAAAAARHSFEKGTWAKAAPAERRKVLLKIAELIERNALELAVLGVRDNGTEISMALKAEPGSAANSFRYYAEAIDKVYGEIAPTAENILGLVHRAPVGVVGAIVPWNFPMMIGAWKIAPALAAGNSIVLKPAEGASLSLLRLAELCAEAGLPEGVLNVVTGAGPVTGEALGLHPDIDVLAFTGSGFVGRKLLEYSARSNLKRVHLELGGKSPNIVFADAPDLAQAAKVSAYGIFRNSGQVCVAGSRLLVERSIAGEVAEKVSTIAAAIKGGDPLGLTTEAGAISSEAQLRKNLDFAEQALSEGAGLRTGGKRILEETGGFYMQPTVFNVEPGMTLAREEVFGPILSIIPFDNEEDALKIANDSDYGFASAVWTSNLSRAHRMVRGIRAGVVHVNTYGGADNTVPLGGVKQSGNGHDKSLHALDKYIDLKTAWIQL

SEQ ID NO: 18193 - protein, 770 aa, Streptomyces thermoviolaceus
MTTAPWQDPALPATARVDDLLARMTLEEKTAQLYGVWVGASTDGDGVAPHQEQMNTDYDWDELITRGLGQLTRSFGTAPVDPAVGARALANAQRRIAEAGRFGIPAVAHEECLAGFTAWGATAYPVPLAWGATFDPQLVEAMAARIGRDMRSVGVHQGLAPVMDVVRDLRWGRVEETIGEDPYLVGTIGSAYVRGLESAGIVATLKHFAGYASSAGARNLAPVRAGVREFADITLPPFEMALREGGARSVMAAYTETDGVPASADPRLLTELLREQWGFTGTVVADYFAIDFLQTLHRVARSTAEAGRLALAAGIDVELPTVKAYGDELVAAVRSGEVPEELVDRAARRVLLQKCELGLLDADWTPEVPEGPVDLDSAENRAVARRLAEESVVLLANPDGVLPLPADGRIAVVGPRAADALAMLGCYSFPSHVGVQHPDVPMGIEIPTVLDALRAELPDAKVTFTEGCGVSDEDTSGFAEAVARAREADVCVAVLGDRSGLFGRGTSGEGCDVADLNLPGVQGALLDALVDSGTPVVLVLLTGRPYALGRWADRLAAVVQAFFPGEEGGPAVAGVLSGRVNPSGRLPVSVPRLPGGQPWTYLQPPLGLAGEVSSLDPTPLYPFGHGRSYTSFRWEDFEGSGDGRIGTDGSYELSLTVRNTGDRAGADVVQLYLHDPVASVTRPDVRLIGYQRVELEPGEARRVTFRFHTDLSAFTDLSGRRVVEPGELELRLAASAADVRHTARLTLTGEVRQVGHDRRLRCETELSTAD

SEQ ID NO: 18194 - protein, 222 aa, Glycine max
  unsure (1)..(222): unsure at all Xaa locations
KNILFAILGSFYSPGTSVATSGVLLGLILLGRAAFVFPLSFISNLAKKSPNEKISFRQQVIIWWAGLMRGAVSIALAYNQFTMSXHTSLRSNAIMITSTITVVLFSTVVFGLLTKPLIKLLLPHTPHHKESSITIITDPSTPSPKSVTVPLLGSAQESEVDIDGHDIHRPSSIRALLSTPTHTVHRLWRKFDDAFMRPVFGGRGLVPIEPGSPTERNGHQWR

SEQ ID NO: 18195 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 18196 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGQSDPSFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 18197 - protein, 432 aa, Arabidopsis thaliana
MAIKDLTATTGDSSLPLIKSPPSETTGGDRTSALQTLGNIIVSIVGTGVLGLPYAFRIAGWLAGSLGVIIVGFATYYCMLLLIQCRDKLESEEGEEESKTYGDLGFKCMGTKGRYLTEFLIFTAQCGGSVAYLVFIGRNLSSIFSSYGLSMVSFILILVPIEVGLSWITSLSALSPFSIFADICNIIAMCFVVKENVEMVIEGDFSFSDRTAISSTIGGLPFAGGVAVFCFEGFAMTLALESSMREREAFPKLLAKVLAGITFVYVLFGFCGYMAYGDQTKDIITLNLPNNWSAIAVQIGLCVGLTFTFPIMVHPLNEIIEQKLKRIDWLQKHHNGYSNETGSVSKFAIFTTRTLLVVGLAAIASLVPGFGTFASLVGSTLCALISFVLPASYHLTLLGPSLNVWNKSIDVFIVICGLIFAVYGTYNTIVGV

SEQ ID NO: 18198 - protein, 455 aa, Mycobacterium tuberculosis CDC1551
MSTTQLINPATEEVLASVDHADANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 18199 - protein, 42 aa, Zea mays
ANQQNASQQKAQEDAKQEAEERRQMMLAQILSSEARERIFRF

SEQ ID NO: 18200 - protein, 419 aa, Prionitis elata
DTDVLALFRVTPQPGVDAIEASAAVAGESSTATWTVVWTDLLTACDLYRAKAYKVDAVPNSSEQYFAYIAYDIDLFEEGSIANLTASIIGNVFGFKALKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDFVAEGPQILQDAAKTC

SEQ ID NO: 18201 - protein, 483 aa, Proteus mirabilis
  unsure (1)..(483): unsure at all Xaa locations
EKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHYRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 18202 - protein, 301 aa, Bacillus cereus ATCC 14579
MTQLSRTKTAIILTFLVFMWGINWPLSKFALHYTPPVLFAGVRTLIGGFILLLFALPKYKELHLKETWHLYVISSLLNIIIFYGLQTVGLQYMPAGLFSAIVFLQPVLLGIFSWIWLEESMYGLKIFGLVLGFIGVGVISSSSLTGHISVIGILLALGCAIGWALGTVFIKKTGHRVNAIWMVTIQLLIGGLCLIGFGSEFESWSSIAWSMPFVSVLLFISFFVIAMGWLAYFTLVGAGEASKVGAYTFLIPLIAIIVSSIFLHEAITMSLFIGLLFIVVSICFVNIKPKTLAVRQQVEVK

SEQ ID NO: 18203 - protein, 635 aa, Eremothecium gossypii
MAKFYLQIGTPLSKKAQRQMHPKQRRTRKPLSGSGEVMEQDGGDGEEEEDDDGVESSYPVAADTIEVDAETENATNSPGTVNAGDADTGPVEARELSELPAEVKQEHNGYGSSMQVDDSGRAVAVEGGLQSSTEKEVDLVVPQTHEIVIPSYAKWFHLNKIHEIEKKSLPEFFTNRIPSKTPQVYVKYRNFMVNSYRLNPNEYFTVTSARRNLCGDAGSIFRVYKFLSKWGLINYQVNSKVKPTAVEPPYTGEYSTRHDAPRGLFPFQSYKPAVQIPDMSRLKKMMTQLRDPITGGNRQESSPSLKTEAGEEQAVDGKRMANGISTGHLRAPKKPRLQDMIDKDWEKGEVIKLLKSLQQHGTDWMQVAKDVGNKTPEQCILRFLQLPIEDNFLDSEENLGPLKYGAHLPFSKADNPVMSTIAFLVGLVDAETVRAMTQRAIKSIDGEEVPSANGTSDETPARVVKDASEIAVASLGARAHVFANNEERALNAVTNELVHTQLRKVDLKLKLLDTMEKSLEVERKALQKQQEEVFLQRFSFSKYAINVLEKFEQALKDTQDPAVMKDNINAIRKMILNPPEFAMGSSSAAPTDMSSGGAHETPGAAAPEGSVAALDITSVKPVSMDAPQLYRYWSG

SEQ ID NO: 18204 - protein, 245 aa, Chlorobium tepidum TLS
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 18205 - protein, 666 aa, Streptococcus pyogenes MGAS8232
MSDSHLTAFDKASKAGFIIALGIVYGDIGTSPLYTMQSLVENQGGVNQVSESFILGSISLIIWTLTLITTIKYVLIALKADNHHEGGIFSLFTLVRKMSPWLIIPAMIGGATLLSDGALTPAVTVTSAIEGLKAVPGLSHIYQNQTNVIITTLVILIVLFGIQRFGTGFIGKIFGPVMFIWFSFLGVSGFFNTLGHLEIFKAINPYYALHLLFSPENHRGIFILGSIFLATTGAEALYSDLGHVGRGNIYVSWPFVKMCIVLSYCGQAAWILANKHSGIELNPFFASVPSQLTVYVVILATLAAIIASQALISGSFTLVSEAMRLKIFPLFRVTYPGANLGQLYIPVINWILFAVTSCTVLYFRTSAHMEAAYGLAITITMLMTTILLNYYLIKEGVKPFLAHLVMTFFALVEFIFFWASAVKFMHGGYVVVILALAIVFVMFIWHAGTRIVFKYVKSLNLNDYKEQIKQLRDDVCFDLYQTNVVYLSNRMQDYMIDRSILYSILDKRPKRARVYWFVNVQVTDEPYTAKYKVDMMGTDYMVRVELYLGFRMPQAVPRYLRTIVHDLMESGRLPKQEQEYTITPGRDVGDFRFVLIEERVSNARQLSNFERFIMQTKASIKHVTASPMRWFGLQYSEVTLEVVPLILSDVLKLPIKELVPVEDSEA

SEQ ID NO: 18206 - protein, 380 aa, Triticum aestivum; identical to SEQ ID NO: 15878

SEQ ID NO: 18207 - protein, 365 aa, Wolbachia endosymbiont of Drosophila melanogaster
MTIRVGINGLGRIGRGVLRAIFEIEEYSKQIEVVAVNGSLSAKQHAHLIKYDSVHGKFSGDIDFNESQNWISINGKKFSLYRERNPENIPWNVDVILECTGAFNKREEAIRHNAEKVIVSAPVPDADVTIVYGVNDDMLEKEHKVISAGSCTTNCLAPIVKVLHSSLGIKSGFMTTIHAYTNDQNVLDGNHKDLRRARACGLSMVPTTTGAAKTIGSIIPELKGKLDGTAVRVPVSNVSMVDFTFTTDKKATVKEINEMFKDAALSSTSFQRVTLESNFWIPVSATRMTSEGTRMTEGYPMSNVLSICEEPLVSIDFVHNPYSAIVDLTGTYVTGDICRVAAWYDNEWAFSLRMLDIALLSYSKV

SEQ ID NO: 18208 - protein, 162 aa, Zea mays
  unsure (1)..(162): unsure at all Xaa locations
KCRPQLLFLLLITRPSFPRGNLVELQKKPIALLEEYFAIRFLDEAPSPLSXGVRGPDCSPEIVKEPCNLAWDKAPSLFRPELESPEHFYQRKFLYVQALDTGWMEIVSKRDDLGEPLQKLPPQLGASLTPRVFLGPEESHTLGVFLKKMGGSITPKPVFILS

SEQ ID NO: 18209 - protein, 539 aa, Oryza sativa
MHAHKRRCATMAVSLVVVVVVVIAIVVPLLYLVLLPAWKPARRDDGDGGMRRRLPPSPPWGLPLLGHLHLLGALPHRALRSLAAAHGPVLLLRLGRVPVVVVSSAAAAEEVMRTRDLEFASRPRVAMAERLLYGGRDVAFAPYGEYWRQTRRICVVHLLSARRVLSFRRVREEEAAALVARVRAAGGAVDLVEHLTAYSNTVVSRAVFGDESARGLYGDVDRGRVLRKLFDDFVELLGQEPMGELLPWLGWVDALNGMEVKVQRTFEALDGILEKVIDDHRRRRREVGRQMDDGGGGDHRDFVDVLLDVNETDMDAGVQLGTIEIKAIILDMFAAGTDTTTTVIEWAMAELITHPDAMRNAQDEIKAVVGITSHITEDHLDRLPYLKAVLKETLRLHPPLPLLVPHEPSSDTKILGYSIPACTRIVINAWTIGRDQATWGEHAEEFIPERFLESGLDYIGQDFVLVPFGAGRRGCPGVGFAVQAMEMALASLLYNFDWETRVVDRRSEFGTSSLDMSEMNGLSVRLKYGLPLIAISRFP

SEQ ID NO: 18210 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEVTRIQYGGSVKPNNIKEYMAQTDIDGALVGGA

SEQ ID NO: 18211 - protein, 514 aa, Neurospora crassa
MDFNSLKDTVSNLTLYDIKAGVRKVQNAVMNYTEMESKVCPYPRATLAPFSCALRHILDPRQETMERELTANPEKSAEEWRQIYKALQLLEYLIKHGSERVVDDARSHLTLLKMLRQFHFIDQNGKDQGINVRNRAKELAELLSDVERIRAERKKARANKGKFTGISGGMSFSSGSSGRYGGFGNTSYGGSSSGGGGSSSTYGGYSGGVYGDGGVFGGQPSNNDYRGTQARAEQFEEYDAGDLDAEASSRTAPRTPRSTTERAGVKKTTAPAEPPKKKEPEIDLFSFDEPAAPSIPTAPLAAAPSNGSGLAALAGGAKDDDDEFDDFQSAAPATQPASAISPPIAPLSTGTQFVAPQPVSAPQQANLSGMVALSSISPPPSSTATPAANFSAFSTPLSPVSQAPKPTGFQAGQPNYFSPVQLQTQSTGSSLSGTKATGSAASKPAAGGDAFGALWSQASAGIKKSTPTTKGPAIGQLAKEKSSAGIWGTPAPSTPTSGSRPTTGGNHGLDDLLG

SEQ ID NO: 18212 - protein, 309 aa, Bacillus anthracis str. Ames
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 18213 - protein, 457 aa, Gracilaria preissiana
NYAVKDTDILALFRVSPQPGVDPVEASAAVAGESSTATWTVVWTDLLTACDLYRAKAYKVDAVPNTTDQYFAFIAYDIDLFEEGSIANLTASIIGNVFGFKAVKAFRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAASGEVKGHYMNVTAATMEDMYERAEFAKQLGTVIVMIDLVIGYTAIQTMGVWARKNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGIDVVLQFGGGTIGHPDGIQAGATANRVALEAMVLARNEGRDYVAEGPQILRDAAKTCGPLQTALDLWKDITFNYTSTDTADFVETPTANV

SEQ ID NO: 18214 - protein, 575 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 18215 - protein, 376 aa, Brassica napus
MGKSEEPKVTKSDNKPSSPPADQTNVHVYPDWAAMQAYYGPRVAMPPYYNSAMAAASGHPPPPYMWNPQHMMSPYGTPYAAVYPHGGGVYAHPGFPMPQGQKGATPLTTPGTPLNIDTPSKSTGNTENGLMKKLKEFDGLAMSLGNGNNGDEGKRSRNSSETDGSSDGSDGNTTGADEPKLKRSREGTPAKDEKKHLVQSSSFRSVSQSSGDNNCVKPSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 18216 - protein, 523 aa, Glycine max; identical to SEQ ID NO: 8334

SEQ ID NO: 18217 - protein, 166 aa, Glycine max
  unsure (1)..(166): unsure at all Xaa locations
MRTKKKEVAYSMISCPVVTTRQRAHGDRYWTVPFTGLKSMAGFPTRKTNNDITXIASNGGRVQCMQVXWPPIGKKKIETLSYLPDLDDAQLAKEVEYLIRKGWIPXLEFELEHGFEYREHNGSPGYYQGLYWTXWKLPMSGCTDASQVLKEHQEAKTAYPNGFIRI

SEQ ID NO: 18218 - protein, 106 aa, Glycine max
TKAIAGKISNWGNVVLAYEPVWALGTGKVASPAQAQEGPADLRKWVHANVRAEVAASVKIIYGGFVNGGNCKKLAAQPDVDGFLVGGAPPKPGFVGIINAAPVKKN

SEQ ID NO: 18219 - protein, 425 aa, Glycine max
MEMERIVEFPHTYMDRPPRKRARLGWDIAEVPKAQVGLFCGQEVENISSFAPSEHPPSSLFKGVARNGSPPWRDDDKDGHYMFELGDNLTSRYKIHGKMGEGTFGQVLECWDRERKEMVAIKIVRGIKKYREAAMVEIEVLQQLGKHDKGSNRCVQIRNWFDYRNHICIVFEKLGPSLYDFLRKNSYRSFPIDLVREIGWQLLECVAFMHDLHMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGAASRESIKAVMKLPRLQNIIMQHVDHSAGDLIHLLQGLLRYDPFERLTARDALRHSFFTRDQLRR

SEQ ID NO: 18220 - protein, 875 aa, Neurospora crassa
MKFAIPLALLASGNLALAAPEPIHPSHQQLNKRSLAYSEPHYPSPWMDPKAIGWEEAYEKAKAFVSQLTLLEKVNLTTGIGWGAEQCVGQTGAIPRLGLKSMCMQDAPLAIRGTDYNSVFPAGVTTAATFDRGLMYKRGYALGQEAKGKGVTVLLGPVAGPLGRAPEGGRNWEGFSTDPVLTGIAMAETIKGTQDAGVVACAKHFIGNEQEHFRQVGESQDYGYNISETLSSNIDDKTMHEMYLWPFVDAIRAGVGSFMCAYTQANNSYSCQNSKLLNNLLKQENGFQGFVMSDWQAHHSGVASAAAGLDMSMPGDTMFNSGRSYWGTNLTLAVLNGTVPQWRIDDMAMRIMAAFFKVGQTVEDQEPINFSFWTLDTYGPLHWAARKDYQQINWHVNVQGDHGSLIREIAARGTVLLKNTGSLPLKKPKFLAVIGEDAGPNPLGPNGCADNRCNNGTLGIGWGSGTGNFPYLVTPDQALQARAVQDGSRYESVLRNHAPTEIKALVSQQDATAIVFVNANSGEGFIEIDGNKGDRLNLTLWNEGDALVKNVSSWCNNTIVVLHTPGPVLLTEWYDNPNITAILWAGMPGQESGNSITDVLYGRVNPSGRTPFTWGATRESYGTDVLYEPNNGNEAPQLDYTEGVFIDYRHFDKANASVLYEFGFGLSYTTFEYSNLKIEKHQVGEYTPTTGQTEAAPTFGNFSESVEDYVFPAAEFPYVYQFIYPYLNSTDMSASSGDAQYGQTAEEFLPPKANDGSAQPLLRSSGLHHPGGNPALYDIMYTVTADITNTGKVAGDEVPQLYVSLGGPEDPKVVLRGFDRLRVEPGEKVQFKAVLTRRDVSSWDTVKQDWVITEYAKKVYVGPSSRKLDLEEVLP

SEQ ID NO: 18221 - protein, 60 aa, Medicago truncatula
SVDSQVTELPFFASKVRLGRNGVEEFLPLGPLSDYERASLEKAKKELATSVEKGVSFIRK

SEQ ID NO: 18222 - protein, 214 aa, Schizosaccharomyces pombe
MCQEDEYDYLFKTVLIGDSGVGKSNLLMRFTRNEFNIESKSTIGVEFATRNIVLDNKKIKAQIWDTAGQERYRAITSAYYRGAVGALIVYDITKQSSFDNVGRWLKELREHADSNIVIMLVGNKTDLLHLRAVSTEEAQAFAAENNLSFIETSAMDASNVEEAFQTVLTEIFRIVSNRSLEAGDDGVHPTAGQTLNIAPTMNDLNKKKSSSQCC

SEQ ID NO: 18223 - protein, 108 aa, Oryza sativa
MAAIIVSVKARQIFDSRGNPTVEVDVVLATYGSFARAAVPSGASTGVYEALELRDGGSDYLGKGVSKAVDDVNSVIAPALIGKDPTSQAGYTGKVVIGMDVASFGILQ

SEQ ID NO: 18224 - protein, 239 aa, Zea mays
  unsure (1)..(239): unsure at all Xaa locations
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSAAAXDSINNRKRKGAGTEEILPQLANRSRHS

SEQ ID NO: 18225 - protein, 327 aa, Oryza sativa
MGFKGFVEGGIASIVAGCSTHPLDLIKVRMQLQGEASAAAAAVAPAQAALRPALAFHAGQAVAIPHDVIAPPRKPGPIAVGAQILRAEGAAGLFSGVSATMLRQTLYSTTRMGLYDILKKKWTQENGGVLPLHRKIAAGLIAGGVGAAVGNPADVAMVRMQADGRLPLAERRNYRSVGDAIGRMARDEGVRSLWRGSSLTVNRAMIVTASQLATYDQAKEAILARRGPGADGLGTHVVASFAAGLVAAAASNPVDVVKTRVMNMKVAPGAPPPYSGAIDCALKTVRSEGVMALYKGFIPTVSRQGPFTVVLFVTLEQVRKVFNGVEF

SEQ ID NO: 18226 - protein, 465 aa, Acrosorium venulosum
AKMGFWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSIEAVNRSIAATGEVKGHYMNVTAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYDTLLLPYLDVNLPLGIFFKQDWASLRKVTPVASGGIHCGQMHQLLDYLGNDVVLQFGGGTIGHPDGIQAGATANRVALEAMVIARNEGVDYVTEGPQILRDAAKTCGPLQTALDLWKDITFNYTSTDTADFVETPTANV

SEQ ID NO: 18227 - protein, 453 aa, Delisea flaccida
KETDVLALFRVTPQPGVDPIEASAAIAGESSTATWTVVWTDLLTACDLYRAKAYKVDAVPNTSDQYFAYISYDIDLFEEGSIANLTASIIGNVFGFKAVKALRLEDMRLPVAYLKTFQGPATGIIVERERMDKFGRPFLGATVKPKLGLSGKNYGRVVYEGLKGGLDFLKDDENINSQPFMRWKERYLYSMEGVNRSIAASGEVKGHYLNVTAATIEEMYERAAFAQQLGSIIIMIDLVIGYTAIQTMAIWARKNDMILHLHRAGNSTYSRQKSHGMNFRVICKWMRMAGVDHIHAGTVVGKLEGDPLMIRGFYNTLLESKLDVNLPQGIFFEQEWASLRKVTPVASGGIHCGQMHQLLDYLGIDVVLQFGGGTIGHPDGIQAGATANRVALESMVMARNEGRDYVAEGPQILLDAAKTCGPLQTALDLWKDITFNYTSTDTADFVETPTANV

SEQ ID NO: 18228 - protein, 387 aa, Escherichia coli CFT073
MTGVSERRRSTCNLKYDEYKARRYRTRDMSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKENEAYLQGQLGNPKGEDQPNKKYYDPRVWLRAGQTSMIARLEKAFQELNAIDVL

SEQ ID NO: 18229 - protein, 153 aa, Glycine max
  unsure (1)..(153): unsure at all Xaa locations
NFLYQWAFAIAAAGITSGSIAERTQFVAYLIYSSFLTGFVYPVVSHWFWSADGWASAISSADHVFSPGDRLLSTGVIDFAGSGVVHMVGGVAGFWGALIEGPRIGRFDHGGXRAXALRGHSASLVVLGTFMLWFGWYGFNPGSINKILVSYGN

SEQ ID NO: 18230 - protein, 498 aa, Mentha x piperita
MELLQLWSALIILVVTYTISLLINQWRKPKPQGKFPPGPPKLPLIGHLHLLWGKLPQHALASVAKEYGPVAHVQLGEVFSVVLSSREATKEAMKLVDPACANRFESIGTRIMWYDNEDIIFSPYSEHWRQMRKICVSELLSSRNVRSFGFIRQDEVSRLLRHLRSSAGAAVDMTERIETLTCSIICRAAFGSVIRDNAELVGLVKDALSMASGFELADMFPSSKLLNLLCWNKSKLWRMRRRVDTILEAIVDEHKFKKSGEFGGEDIIDVLFRMQKDTQIKVPITTNSIKAFIFDTFSAGTETSSTTTLWVLAELMRNPAVMAKAQAEVRAALKEKTNWDVDDVQELKYMKSVVKETMRMHPPIPLIPRSCREECVVNGYTIPNKARIMINVWSMGRNPLYWEKPDTFWPERFDQVSKDFMGNDFEFVPFGAGRRICPGLNFGLANVEVPLAQLLYHFDWKLAEGMKPSDMDMSEAEGLTGILKNNLLLVPTPYDPSS

SEQ ID NO: 18231 - protein, 589 aa, Microbulbifer degradans 2-40
MDHSTIFNVLAYLGAAVVAVPLFRKLGLGAILGYLFAGAVIGPQGFQFIDHPESALHFAEFGVVMLLFLIGLELNPEKLWNMRVQIGLLGGGQLLISALIIAVSLVVGMQWGWHLAIITGLTLGLSSTAFAVQLMDEQGIMGTALGRKGFSILLLQDMAVIPLLLLVSAWAPTSIESTSGHALPWWSGLCAVIAVLLIGRFALGPILTLVARYGSKEVLTAGSLLIVLGTAVLMQYVNLSMGMGAFLAGIILANSSFRHQLEADIEPFKGLLLGLFFIAVGMSLDLQLLLKEPLVILGLALALMLAKATVIMLLTQLRACTWKEGFLLGLMLSQGGEFAFVVMTKAVGLNVIDQSLANYVVMVVGISMALTAPLVMLFKRFIHKPIPANTNYDAATGEEPEVVIAGFGRFGQIVGRILVANNIHFTALDKDPTHVDFVKQFGNKIFFGDAARMDLLRAAGIDHARVLIIAVDDMEDATRIAQQVRHEFPKLKIIARAHNRMHNYQLVAAGCNEIIRETFESSLHAARSTLVALGVNDGQAMFKVELFRMHDEELIQRAAKHRDDMPELLKIAQEGRKELERLFEQDKHN

SEQ ID NO: 18232 - protein, 155 aa, Glycine max
  unsure (1)..(155): unsure at all Xaa locations
MKLVGTKNYYDVRKEXEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLXKSHGALSFLKGHNAGHMVPMDQPKA

SEQ ID NO: 18233 - protein, 426 aa, Streptomyces coelicolor A3(2) [sequence omitted]

SEQ ID NO: 18234 - protein, 464 aa, Streptomyces avermitilis MA-4680
MVNDSGDRGRPREARPAGRHQEEHDLDVEEALALVREPGSREPEPARDTPSAPAPSPRTTSHAQHQATPWPEARVTAERAARSVPRRAPVSVPLDAALGLVLAAPLTALTDLPSFDTSAMDGWAVAGPGPWDVRDEGVLAGHAGPRSLGDGEAVRIATGARVPQDTTAVLRSEHGTTDDKERLHATREVVHGQDIRPRGQECRSGDQLLPAGALATPAVLGLAAAAGYDTLSAMPRPRVEILVLGDELLTAGLPEDGLIRDALGPMLPPWLRALGTEVVAVRRLGDDAEALYQAVKGSDAELIVTTGGTAAGPVDHVHPVLRRLGAELLVDGVKVRPGHPMLLARTRENQHLVGLPGNPLAAVSGLLTLAEPLLRVLAGRAAPEPYTLPLRDTVHGHPYDTRLVPVVVRADRAVPLHYNGPAMLRGIAAADALVVVPPGGAHPGQELELLDLPWAWAGIGECFT

SEQ ID NO: 18235 - protein, 485 aa, Ralstonia eutropha
MNAPESVQAKPRKRYDAGVMKYKEMGYWDGDYEPKDTDLLALFRITPQDGVDPVEAAAAVAGESSTATWTVVWTDRLTACDMSVQGLRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKGGLDFMKDDENINSQPFMHWRDRFLFVMDAVNKASAATGEVKGSYLNVTAGTMEEMYRRAEFAKSLGSVIIMIDLIVGWTCIQSMSNWCRQNDMILHLHRAGHGTYTRQKNHGVSFRVIAKWLRLAGVDHMHTGTAVGKLEGDPLTVQGYYNVCRDAYTHADLSRGLFFDQDWASLRKVMPVASGGIHAGQMHQLISLFGDDVVLQFGGGTIGHPQGIQAGATANRVALEAMVLARNEGRDILNEGPEILRDAARWCGPLRAALDTWGDISFNYTPTDTSDFAPTASVA

SEQ ID NO: 18236 - protein, 317 aa, Haemophilus somnus 2336
MTTQLDALRNMTVVVADTGDIDAIKKYQPQDATTNPSLILSASSLPQYAPLIDEAIAYAKAKSADKTQQLIDAEDKLAVNIGLEILKIVPGRISTEVDARLSYDTQATVEKARKLIALYNEAGISNDRILIKIASTWQGIRAAEILEKEGINCNLTLLFSKAQARACAEAGVYLISPFVGRILDWYKANSDKKEYAPAEDPGVISVTKIYNYYKQYGYNTVVMGASFRNVGEITELAGCDRLTIAPALLKELQENSTALVRKLAFKGEVKAKPQPLTESQFYWQHNSDPMAVEKLADGIRKFAIDQEKLEKMLLEKF

SEQ ID NO: 18237 - protein, 457 aa, Sphacelaria cirrosa
  unsure (1)..(457): unsure at all Xaa locations
DYNVKETDILALFRITPQPGVDPVEAAAAVAGESSTATWTVVWTDLLTACDIYRAKAYRVDPVPGTSDQYFAYVAYECDLFEEGSLANLTASIIGNVFGFKAVKALRLEDMRIPFAYLKTFQGPATGLVVERERLDKFGRPFLGATVKPKLGLSGKNYGRVVYEGLRGGLDFLKDDENINSQPFMRWKERFLYCMEGVNRAAASTGEVKGSYLNITAATIEQMYXRAEFAESVGTVICMIDLVIGYTAIQTMAIWARKAQLILHLHRAGNSTYARQKNHGINFRVXCKWMRMCGVDHIHAGTVVGKLEGDPLMVXGFYNTLLLTELKVNLAEGLFFDMDWASLRKCVPVASGGIHCGQMHQLLYYLGDDVVLQFGGGTIGHPDGIQAGATANRVALEAMVLARNEERDYVGEGREILRVASTTCGPLKAALDLWKDITFEYTSTDTPDFVETATQSN

SEQ ID NO: 18238 - protein, 255 aa, Eucalyptus gunnii
  unsure (1)..(255): unsure at all Xaa locations
MGRSPCCEKAHTNKGAWTKEEDDKLIAYIRAHGEGCWRSLPKAAGLLRCGKSCRLRWINYLRPDLKRGNFTEEEDEIIIKLHSLLGNKWSLIAGRLPGRTDNEIKNYWNTHIRRKLLNRGIDPATHRLINEPAQDHHDEPTISFAANSKEIKEMKNNAELNFMCNLEESADVASSARERCPDLNLELGISPPSHQLHQPEPLLRFTGRKSDLCXECNLGLKNSQNCRCSVGVIESETSVGYDFLGLKASVLDYRS

SEQ ID NO: 18239 - protein, 703 aa, Bacillus sp. 1-1
MNDLNDFLKTILLSFIFFLLLSLPTVAEADVTNKVNYSKDVIYQIVTDRFSDGNPGNNPSGAIFSQNCIDLHKYCGGDWQGIIDKINDGYLTDLGITALWISQPVENVYALHPSGYTSYHGYWARDYKKTNPYYGNFDDFDRLMSTAHSNGIKVIMDFTPNHSSPALETNPNYVENGAIYDNGALLGNYSNDQQNLFHHNGGTDFSSYEDSIYRNLYDLADYDLNNTVMDQYLKESIKFWLDKGIDGIRVDAVKHMSEGWQTSLMSEIYSHKPVFTFGEWFLGSGEVDPQNHHFANESGMSLLDFQFGQTIRNVLKDRTSNWYDFNEMITSTEKEYNEVIDQVTFIDNHDMSRFSVGSSSNRQTDMALAVLLTSRGVPTIYYGTEQYVTGGNDPENRKPLKTFDRSTNSYQIISKLASLRQTNSALGYGTTTERWLNEDIYIYERTFGNSIVLTAVNSSNSNQTITNLNTSLPQGNYTDELQQRLDGNTITVNANGAVNSFQLRANSVAVWQVSNPSTSPLIGQVGPMMGKAGNTITVSGEGFGDERGSVLFDSTSSEIISWSNTKISVKVPNVAGGYYDLSVVTAANIKSPTYKEFEVLSGNQVSVRFGVNNATTSPGTNLYIVGNVNELGNWDADKAIGPMFNQVMYQYPTWYYDISVPAGKNLEYKYIKKDQNGNVVWQSGNNRTYTSPTTGTDTVMINW

SEQ ID NO: 18240 - protein, 333 aa, Glycine max
  unsure (1)..(333): unsure at all Xaa locations
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILFXEDEPRLREVLKFANACGAITTTQKGAIPALPKEEAALKLIKGGS

SEQ ID NO: 18241 - protein, 306 aa, GIBBERELLA ZEAE PH-1
MASVNFSPDTDIPSLNGKVILITGGNSGLGLESTRQLLKHDPAKIFLACRSKAKYDQAIAELQEQGSKTDAVSFLSLNLASLESIKSAVRQFQQESTRLDVLLNNAGIMMTPEGLTEEGYEIQIGTNHMGHAFLTHLLLPVLEETTKINPDVRVICLASMGEAMAPKNPYQFEQFKTTMSNFSTSARYYISKLANVHYAAALAERHPSLKIISIHPGIVQTNLTGPAVSNSLIMGTLTRLFFSVVGVNSSKGALNQLWALSDPKAESGVFYHPVGVTGKGSKLSQNKDARESLWEWTEKEIKQHLS

SEQ ID NO: 18242 - protein, 387 aa, Shigella flexneri 2a str. 301
MTGVSERRRSTCNLKYYEYKARRYRTRDMSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 18243 - protein, 213 aa, Oryza sativa (japonica cultivar-group); identical to SEQ ID NO: 16414

SEQ ID NO: 18244 - protein, 592 aa, Neocallimastix frontalis
MLAPIQTIARPVSSILPATGALAAKRTFFAPSEVYNKKQVIVTKKTGLDILNDPKLNKGSAFTADEKDRLGIRGLVPPRPQSLEAQYKRCKTNLDKISDPLEKFIYLNHLQNRNETLYYKMILENFVELAPIIYTPVVGEACQKFHKIFTQTRGMYFSTADRGQMSAVAANWPYDDVDVIVVTDGSRILGLGDLGAGGMQIPIGKLTLYVCGGGINPRNVLPIVLDVGTNNKELLNDPLYLGMQHPRLQGEEFHAFVDEWVSAITDRFPKAVIQFEDFMMPNALDLLLKYKDQICMFNDDIQSTGAITLASVLATMRARGGTFADIKKETFLCLGAGSSGVGVCETIVDCIVAEGATREEAYAQFYMFDHKGLLGKGRDDLLPSQQVFMRKEIEGGKTPAELLKKIKPTCLLGLSTCPKLFNKEMLSYVASYCEKPGIFPLSNPTSRSECTAEEAVEFTDGNLIFASGSPFDPVEWKGKTIQTNQCNNSYSFPGIGLGLVSSRATRVPFETFQVCARVIASLGTPEMLATGKIFPDLDNLRAVSLEVGIEVAKMAERMNIATQFPPKGMDWREWLKHNMWQPEYPHIVVKNL

SEQ ID NO: 18245 - protein, 295 aa, Hordeum vulgare subsp. vulgare
ARVEEWRVKQRDTEEWMKHRQLPPELRARVRRFIHYKWLATRGVDEASILKALPADLRRDINRHLCLDLVRRVPFFSQMDDQLLDAICGRLVSSLSTKGTYTVREGDPVTEMLFIIRGKLESSTTDGGRTGFFNSIILKSGDFCGEELLGWALVPRPTVNLPSSTRTVKALVEVEAFALQAEDLRFVASQFRRLHSRKLQHTFRYYSHHWRTWAACFIQATWRRHKRRRLARDLMMRESFSSMRSYEDGDGSGSFAAHGLSAKIMAAARKGSDGHRELPKFRKPSEPDFSVEHDD

SEQ ID NO: 18246 - protein, 492 aa, Agrobacterium tumefaciens str. C58; identical to SEQ ID NO: 442

SEQ ID NO: 18247 - protein, 233 aa, Oryza sativa
MAAGAACCYRPAAAGRASLDAFATSSPSLRPSSSGVFFISSSSSRWWMRRRRGEGKVKISSSSRARAKPMSRPALFSPVAMEWQECSTEIEVDVPCSVAYQCYSERETIPQWMPFISSVKILEDKPDQSRWTLKYEILGRDVEFSWLARNMTPTKNQKIHWRSLEGLQNRGAVRFFPKSSSSCRVQLTVAYEVPEILAPVASALKPFLEGLLMQGLERFATFAKERYSKIPQP

SEQ ID NO: 18248 - protein, 345 aa, Ralstonia eutropha
MALISLRQLLDHAGEFGYGVPAFNVNNLEQIHAIMEAAEETDSPVILQASAGARKYAGEAYLRHMVLAAAETHPDIPIVLHQDHGSSPAVCQASIRSGFTSVMMDGSLREDMKTPSDYDYNVDVTRRVCEMAHAVGVSVEGELGCLGSLETGQAGEEDGVGAAGTLSHDMMLTDPAQARDFVARTGVDALAIAIGTSHGAYKFSRKPTGDILAIDRIREIHEQIPDTHLVMHGSSSVPQEWLEIIRQYGGDIKETYGVPVEEILRGIKTGVRKVNIDTDIRLAMTGAIRKSLAEDRSEFDPRKALLAAKKGARSVVKLRFEAFGCAGQASKIKPIAMEQLAQWYR

SEQ ID NO: 18249 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 18250 - protein, 324 aa, Zea mays
  unsure (1)..(324): unsure at all Xaa locations
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTXXGVILYSESXXRSNKP

SEQ ID NO: 18251 - protein, 358 aa, Schizosaccharomyces pombe
MGILDIVPTGVIAGDNVLKLFTYAREHGFAIPAINVTSSSTAIAALEAAREARSPIILQTSNGGAHFFAGKESSNEGQKASIAGSIAAAHYIRSIAPFFGVPVVMHSDHCAKKLLPWMDGMFEADEAYFKIHGEPLFSSHMLDLSEEPKKENIAQVKEYCKRAVPMKIWIEMEIGITGGEEDGVDNSHVSHTELYTQPEDIWDVYRELSSVTPYFSIAAAFGNVHGVYKPGNVKLQPALLGQHQAYVKEQLKTTNDKPVFFVFHGGSGSSVNEFRTGIKCGVVKVNIDTDTQFAYVEGVRDYVLKYKDYLMTPVGNPEGADKPNKKKFDPRVWIHEGEKTMTKRVLTALEDFYTVNTL

SEQ ID NO: 18252 - protein, 402 aa, Oryza sativa
MASPMLSAATVPLQGGGLSEFSGLRSSSSLPLRRNATSDDFMNAVSFRTHAVGTSGGARRAPTEAKLKVAINGFGRIGRNFLRCWHGRGNSSPLDVIAINNTGGVKQASHLLKYNSTLGIFDADVKPVGDNAISVDGKVIKVVSDRNPSNLPWGELGINLVIKGTGVFVNRDGAGKHIQAGAKKVLITAPGKGDIPTYVVGVNADQYSPDEPIISNASCTTNCLAPFVKILDQKFGIIKGTMTTTHSYTGDQRVFDGSHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 18253 - protein, 533 aa, Saccharomyces cerevisiae
  unsure (1)..(533): unsure at all Xaa locations
MTEDNIAPITSVKVVTDKCTYKDNELLTKYSYENAVVTKTASGRFDVTPTVQDYVFKLDLKKPEKLGIXLIGLGGNNGSTLVASVLANKHNVEFQTKEGVKQPNYFGSXTQCSTLKLGIDAEGNDVYAPFNSLLPXVSPNDFVVSGWDINNADLYEAXQRSQVLEYDLQQRLKAKXSLVKPLPSIYYPDFIAANQDERANNCINLDEKGNVTTRGKWTHLQRIRRDIQNFKEENALDKVIVLWTANTERYVEVSPGVNDTXENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYXKPVGDSKVAXDEYYSELXLGGHNRISIHNVCEDSLLATPLIIDLLVXTEFCTRVSYKKVDPVKEDAGKFENFYPVLTFLSYWLKAPLTRPGFHPVNGLNKQRTALENFLRLLIGLPSQNELRFEERLL

SEQ ID NO: 18254 - protein, 444 aa, Glycine max
  unsure (1)..(444): unsure at all Xaa locations
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGXKKLLKTFLVKVAYTGNDMMETNLPVQVFMVIPVGTYELKVAEDNGDGAXEHLWRRLERXYKSFVTEYPIVSIEDPFDQDDWEALXLSLMLRSEAMYKLIVIIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 18255 - protein, 437 aa, Oryza sativa
MEYGTPQHFMCPISLQPMQDPVTSPTGISYDRRAIHRWLAAGHSSCPVTGHPLSLSDLTPNLTLRRLIHSWHHSTTTPFPVERSTPSPPPLREVDDDDVVERLVMEMEGGGGGSWCPPSCDLLREAAAVAAGSGVARRRMVGAGVLRRVLRLVVWCGGRGSSSGEAAVMVEMFDACLALFHALDVSADELRPLVADGHDLVDAVTRVMATLEAGDANATRARESAVRLLEAVTEAADAPVLERLSPEFFSAATAVVRDRGAVSPGAARAAVRALANACRARASGACRNRALAVDAGAAREAIELELDAWSSPQAPGGRRATEAVMALLAELCACAEGRAAVASHPAGITVVARRVLRVSAAADACAVRVLAAVAGRAASPEVLREMARVGAVGKLCCVLQAECDAGVKEAARAVLRMHSGVWSGSPCVSAYLLSRYL

SEQ ID NO: 18256 - protein, 185 aa, Methanosarcina acetivorans C2A
MESTITIENVVASTALATEFDLVKIMDSGLEGAEYNKTKFPGLVYRIDNPKAAFLIFTSGKVVCTGAKTINNAHKAITNLANKLKDIGCDKINLEPEIHVQNIVASADLKTTLNLNTIAIAFGLENVEYEPEVFPGLIYRVEAPKVVVLVFSSGKLVITGGKCEEDCNGGLRIVRKEFDNLGLLC

SEQ ID NO: 18257 - protein, 585 aa, Pseudomonas aeruginosa PAO1
MHAVDFIQDLAVIMLVAGVVTILFHRLRQPVVLGYIVAGFIIGPHTPPFGLIHDEDTIKTLAELGVIFLMFCLGLEFSLRKLFQVGATAFIAAFLEIVLMIWIGFEIGRFFEWSTMDSLFLGAILAISSTTIIVKALGDLKMKNERFAQLIFGVLIVEDILGIGIIALLSGIAVSGSVETGEVFSTVGKLSLFMIVALVVGILLVPRLLAYVAKFESNEMLLVTVLGLCFGFCLLVVKLEYSMVLGAFLIGAIMAESRQLVQIERLIEPVRDMFSAIFFVAIGLLIDPKILVEYAWPIALITVAVVLGKMFSCGMGAFIAGNDGRTSLRVGMGLSQIGEFSFIIAALGMTLKVTSDFLYPVAVAVSAITTLLTPYLIRAADPLSQHLANAMPQRMARIFGHYGDWLRSIQPQGDRAVLAAMIRRILLQVGVNLALVIAIFLAGGYFADTLSAWMSQWVAYDGLHKALIWGGALLVSLAFLIAAYRKLKALSMLLAELGVKPEKAGRHTARVRRVISEIIPLLSLAGMMVLLAALSSSILPPGELLVVVVLVAGLVIAVLWRWLIRVHSRMQIALMETLDQEKGSH

SEQ ID NO: 18258 - protein, 605 aa, Oryza sativa
MELALVGNPSNGVAKPSCNSVGSLPVVSSNAVINPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 18259 - protein, 480 aa, Neisseria meningitidis MC58
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 18260 - protein, 395 aa, Glycine max
HRVIRDGYKAGNLKSAMNCSYVKDYEFVAIFDADFQPTPDFLKKTVPHFKDNDDLGLVQARWSFVNRDENLLTRLQNINLSFHFEVEQQVNGIFINFFGFNGTAGVWRIKTLEDAGGWLERTTVEDMDIAVRAHLHGWKFIFLNDVECQCELPESYEAYRKQQHRWHSGPMQLFRLCLPDIIRAKISVWKKFNMIFLFFLLRKLILPFYSFTLFCIILPMTMFVPEAELPAWVVCYIPAAMSFLNILPAPKAFPFIVPYLLFENTMSVTKFNAMISGLFQLGSAYEWVVTKKSGRSSEGDLVSLIEKGPKHQRGSSAPDLEEMKEELRKQEQQKASKKKKKHNRIYMKELALAFLLLTASARSLLSAQGIHFYFLLFQGISFLLVGLDLIGEQVD

SEQ ID NO: 18261 - protein, 511 aa, Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 18262 - protein, 370 aa, Saccharomyces cerevisiae
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGRINQITTDLKLLEFDENVELGHLSPDELSSVKKKLYPKSK

SEQ ID NO: 18263 - protein, 175 aa, Triticum aestivum
  unsure (1)..(175): unsure at all Xaa locations
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCXTDATQVINEVEEVKKEYPDAYVRIIGFDNMRQVQCVSFIAFKPPGCEESXG

SEQ ID NO: 18264 - protein, 219 aa, Francisella tularensis
MNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGL

SEQ ID NO: 18265 - protein, 401 aa, Pseudomonas fluorescens PfO-1
MSKPGLMPVEDALDQLLAMADEQRLPDSESVPLNEARGRVLASDLVATLDLPPWPNSAMDGYALNLPDLHRQPLSVSQRVYAGMAPDALLPGTCARIFTGAPLPPGANCVEMQENVEVLEDGRVRFLQPLKAGQNIRAQGQENRVGDTLLRAGKRLGPFELAVAAGQGMTHLPLVRRPRVALLSTGDELVEPGQPLRPGSIYNSNRTLLDHWLRELGCEVIDAGILPDRPAQTRLKLEQLQVAADLILTTGGVSAGDADCLGQVLRDNGKPLLWKLAIKPGKPLTVGHFGSVPVIGLPGNPTSALVTFGLLARPYLLRIQGVEEVMPLSFTVNAGFDWPKPGSRREYLRVRLEGGQAALYPNQSSGVLLGATWADGLVEIPENSTLQRGAPLRFIPFSELF

SEQ ID NO: 18266 - protein, 175 aa, Triticum aestivum
  unsure (1)..(175): unsure at all Xaa locations
MAPTVMAXSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 18267 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFFVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYNSRVVDLIVHMSKA

SEQ ID NO: 18268 - protein, 267 aa, Arabidopsis thaliana
MMARPRNHRPSARKSSHSTLVFAVLIMSTFVILILLAFGILSVPSNNAGSSKANDLTSIVRKTLQRSGEDDSKNERWVEIISWEPRASVYHNFLTKEECKYLIELAKPHMEKSTVVDEKTGKSTDSRVRTSSGTFLARGRDKTIREIEKRISDFTFIPVEHGEGLQVLHYEIGQKYEPHYDYFMDEYNTRNGGQRIATVLMYLSDVEEGGETVFPAAKGNYSAVPWWNELSECGKGGLSVKPKMGDALLFWSMTPDATLDPSSLHGE

SEQ ID NO: 18269 - protein, 752 aa, Guillardia theta
MNRLIVDEINQNADDNSVVYLNSNKIDNLKLFRGDTILIKTKKKKDTVCIIMSDDNCELEKIRINKTVRENLNIGIGDIVTIHHFTDLKFGKRIHVLPFKDSILGYNGNIFEDFLKPYFLDAYRPIKKGDVFNIKSGNNTFDFRVIEIDPVDYCIVGPDTIIFCEGEPLDRLDTVDYEKITYESIGGCQKQLSQIRELVELPLKHPQLFNTVGIKPPRGVLMYGPSGCGKTLIAKAVANETGAFLYSINGPEIMSKLAGESESNLKKAFDEAEKNSPSIIFIDEIDSIAPKRDKSQGEVERRIVSHLLTLLDGINLNSQVVVIACTNRPNSVDQALRRFGRFDREIDISVPDDKGRLEILQIHTKNMLIDNSVDLEAICKETYGFVGADLAQLCTEAALLCIKESIENFDLEEENIPLVVLNSLRVSQDHFKLALDQSNPSAFRETAVEIPNITWEDIGGLENVKRELQETVQYPVEHPEKFEKFGMQPSKGVLFYGPPGCGKTLLAKAIANECQANFISIKGPELLTMWFGESENNVREVFDKARQASPCVLFFDELDSIARARGSSGSDGGGAGDRVINQILTEIDGVGVRKNVFVIGATNRPDILDPAIMRPGRLDQLVYIPLPDRKSRIQIFRATLRKSPLSKEIDLEVLSRATSGFSGADITEICQRACKLAIRESIFKDIQFAKNSESIVSNNEKYIDPVPEITKEHFLEAMKYARRSVSDSDIRKYEMFAQKLQTSRGFSKEIKF

SEQ ID NO: 18270 - protein, 396 aa, Helianthus annuus
MAIRINTATFQSDLYRSFAFPQPKPLRSPKFAMASTIGSATTKVESTKKPFTPPREVHQQVLHSMPPQKIEIFKSMEGWAEDNILVHLKPVEKCWQAQDFLPDPASDGFMEQVEELRARAKEIPDDYFVVLVGDMITEEALPTYQTMLNTLDGVRDETGASPTSWAIWTRAWTAEENRHGDLLHQYLYLSGRVDMRQIQKTIQYLIGSGMDPRTENSPYLGFIYTSFQERATFISHGNTARHAKEHGDVKLAQMCGIIAADEKRHETAYTKIVEKLFEIDPDGTVLAFADMMRKKISMPAHLMYDGRDDNLFENFSAVAQRLGVYTAKDYADILEFLVGRWKVADLTGLSGEGRKAQDYVCGLAPRIRRLEERNSARAKESVNVPFSWIFDREVKL

SEQ ID NO: 18271 - protein, 99 aa, Zea mays
  unsure (1)..(99): unsure at all Xaa locations
MDPTKLRECSSHXSTETTTNAGSXVRNDNDALTVGPRVHHXLLEDYHLIEKAGHFPRERMLQRVVHAHGGSYXGLFECTHHGTDLTCADFVLARVCGRP

SEQ ID NO: 18272 - protein, 599 aa, Oryza sativa; identical to SEQ ID NO: 17505

SEQ ID NO: 18273 - protein, 567 aa, Nitrosomonas europaea ATCC 19718
MSTELTGAEITIRCLQEEGVSHIFGYPGGAVLFLYDELFKQDKVKHILVRHEQAALHAADGYARSSNKVGVALVTSGPGVTNAVTGIATAYMDSIPMVIISGQVPTAAIGQDAFQEVDTVGITRPCVKHNFLVKDVSELAVTIKKAFYIASTGRPGPVLVDIPKDVTQQKAEFHYPASISLRSYSPVINGDAQQLRKAVQMILEAKRPMVYTGGGVILDDAAAELTELVQMLNFPCTSTLMGLGGYPATDRQFVGMLGMHGTYEANMAMQYCDVLIAVGARFDDRVIGNPKHFYSEERKIIHIDIDPSSISKRVKVDVPIVGSVSAVLKELIMLLRAGRETTDVHALNKWWEQVELWRARDCLKYDRSASVIKPQLVVEKLYEITGGDAFITSDVGQHQMWAAQFYKFDKPRRWVNSGGLGTMGFGLPSAMGVQMANPGSTVACITGEASIQMCIQELSTCKQYRLPIKIINLNNRYMGMVRQWQEFFHGNRYAESYMDALPDFVKLAESYGHVGMRIDKPEDIDGALREAFKLEEQLVFMDFITDQTENVFPMVPGGKGLSEMILV

SEQ ID NO: 18274 - protein, 290 aa, Bradyrhizobium japonicum USDA 110
MNHNQEALTARAAPILFVLLWSTGFIGTKYVISNADPLTYLAIRMAIVVGLMAIIAGIARPKWPNRIGIAHSAVAGILVHGFYLGGTAIAIAHSIPAGLSALIPGLQPILTSTIANRWLGEKVTPVQWAGLVLGLGGVVLILHNRPTTGEAGLGWLASVVSLISITLGTLYQRRYCNHIDWRAGNFVQYVAVTIFFAIGAFLFEDRVVHWTREFVLALAWLTVALSIGSIGLLYWLIRHAAATSVASLFYLVPAVTALMAYALFDEKLDALAIAGMAMCAAAVFVVNRRV

SEQ ID NO: 18275 - protein, 454 aa, Desulfitobacterium hafniense
MQRRSNGSGPLCTILRSRESSPQTEPSGNMPIRFGGCAAAEWTKEAEWSEEKGGGIMRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 18276 - protein, 162 aa, Lactobacillus rhamnosus
VVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIAT

SEQ ID NO: 18277 - protein, 530 aa, Oryza sativa; identical to SEQ ID NO: 13112

SEQ ID NO: 18278 - protein, 774 aa, Neurospora crassa
MKSSWASYCLLSCTSALVSAIDLPFQTYPDCVNGPLASLKVCDATLSPPQRAAALVAAMTTEEKLQNLVSKSKGAPRIGLPAYNWWSEALHGVAYAPGTQFRSGDGPFNSSTSFPMPLLMAATFDDELIEKVGEVIGTEGRAFGNAGFSGFDYWTPNVNPFKDPRWGRGSETPGEDILRIKRYAASMIRGLQGPLPERRVVATCKHYAANDFEDWNGSTRHDFDAKVTLQDLAEYYLSPFQQCARDSKVGSIMCSYNAVNGVPACANTYLMQTILREHWNWTAPGNYITSDCEAVLDIFANHHYAKTNAEGTALAFEAGTDSSCEYESSSDIPGAWTQGLLEQSTVDRALTRLYEGLVRVGYFDGNHSEYASLGWKDVNSPKSQEVALQTAVEGIVLLKNDQTLPLGLKTDPKSKLAMIGFWANDPKTLSGGYSGKPAFEHSPVYAAEAMGFNVTTAGGPVLQNSTSNDTWTQAALEAAQDANYILYFGGLDTSAAGETKDRTTINWPEAQLQLIKTLTKLGKPLVVVQMGDQLDNTPLLATKTVNSILWANWPGQDGGTAVMQILTGLKSPAGRLPVTQYPANYTAAVPMTDMNLRPSDRLPGRTYRWYPTAVQPFGFGLHYTTFQAKIAAPLPRLAIQDLLSRCGGDNANAYPDTCALPPLKVEVTNSGNRSSDYVVLAFLAGDAGPRPYPIKTLVSYTRLRDVSPGHKTTAHLEWTLGDIARYDEQGNTVLYPGTYTVTVDEPAQASASFVVEGEAVVLDRWPAPSGQVVV

SEQ ID NO: 18279 - protein, 386 aa, Corynebacterium glutamicum ATCC 13032
MSLMKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 18280 - protein, 101 aa, Gerbera hybrid cultivar
MAISKPFLAFALLSMLLLLQLGQAYEMVNKIDEATIAASKINCGAACKARCRLSSRPNLCHRACGTCCARCRCVPPGTSGNQKVCPCYYNMTTHGGRRKCP

SEQ ID NO: 18281 - protein, 815 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHWITRYNRIKADLDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 18282 - protein, 342 aa, Streptomyces hygroscopicus subsp. yingchengensis
MAQPPALPVIDISRFRAPDAADRDAFLAELRSAAHEVGFFYVTGHGVPAPLRDEVLSAARAFFALPVERRLEIENLNSPQFRGYTRTGTEYTAGSAYWREQIDIGPEREALALGPDDPDYLRLIGPNQWPSALPELRDIVLRWQAEALRVSREVLRALAAALGQDEGYFDQWFDDEAAVHVKIVHYPPRAAEDADQGVGAHKDYGYLALLQQDEVGGLQVQREDGEWIDAVPVPDAFVFNIGEMLEIATQGYLKATQHRVVSPQAGVHRYSIPFFLGPRLDAVVKPLNLPAELAALSRGVTDDPDNPLLAAFGENAVVGWLRSHPRVAERWWSDVLEKRESR

SEQ ID NO: 18283 - protein, 126 aa, Salmonella enterica
LCQNRCSAITVLVCTATCRWRRTAPTCSLATNMPVCLSRRCTTSAASSNTAKAINALANPTTNSYKRLVPGYEAPVMLAYSARNRSASIRIPVVASPKARRIEVRFPDPAANPYLCFAALLMAGLD

SEQ ID NO: 18284 - protein, 299 aa, Novosphingobium aromaticivorans
MRAAKRSASLRSLRSSPGMVSTATVASSPMTRRTTSISTSEKPFAAGRVGVSQVGTVTRMRQKRDGFTTNPVGASSCGRRVRCGRRKAMTQSSSESCAGRLLAAPGMMRVPSPRLEMFVVRDFLSQAECNGLIARIERDRRPSTIADANGDHYFRTSETCDLPMDDPEIVALDEKLCALSGIGRPFGEPIQGQRYESGQEFKAHTDYFDPHGADFQRFCSVAGQRTWTFMVYLNDVEAGGATRFKVIDKTIQPERGKLVCWNNRRPDGTVNPCTLHHAMKVRKGLKYVITKWYREKPWG

SEQ ID NO: 18285 - protein, 374 aa, Zea mays
MVLEATMICVDNSEWMRNGDYPPSRFAAQAHAFAVLSGAKTEANLESTVGLVAMAGKGVSVLVPPTNDFGKVLSGMNGLEIGGEANLTAAIQVAQFALKNRQNKQLRQRIIVFVGSPVIDEKNWLEVIGKNLKKNNVALDVVNFGESDNEKPEKLEALVAAVNSGGNSHIIHIPAGRDLSDALFSSPIILSEDRGSDSAAAARGASGFEFDVDPNVDPELALVLLISMEEERLRQEAAAKKAREESSKTENEGQSSTSNGDIVMADAEPEPNSYTEDKGLHCKDEGQLLEKARKIRIEDYISFEELFDGVTSDTMSAFQEEETCTQSDAGKDFGHQPFEPSPKKRHKKYKRRHHQKKPKKKREKKEDEAEGDKL

SEQ ID NO: 18286 - protein, 253 aa, Rumex acetosa
MEFSNELSRDMEDGSPQRKMGRGKIEIKRIENVTNRQVTFCKRRNGLLKKAYELSVLCDAEVALIVFSSRGRLYEYANHSVKATIERYKKTCSDSTGVTSVEEANAQQEAAKLRNQIRTLQNQTRNTSRNLMGEGLTSMNMKDLKNLETRLEKGISRVRAKKNELLFGEIEFMQKKEIELHNNNQFLRAKIAESERSQQSMNLMPGSSSGEQHYELMPQSQAGPFDSRNFFQVSDLQPDERYSCQNQTPLQLV

SEQ ID NO: 18287 - protein, 142 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 18288 - protein, 341 aa, Oryza sativa
MDSGSRSSGGAGFDDDDGVAARREVSSSLKELTVRVDGKGGSCSGSGTDQRPSSPRSKHSATEQRRRSKINDRFQILRELLPHSDQKRDKATFLLEVIEYIRFLQEKVQKFEASVPEWNQENAKILPWSNIYFRSFWKNSQSKGQNPGDDLPDPSQFIRNGSSSGYNFTGKPDDNHNMVTSAAASGAQELVETDHAASVSYRSAETPTNITNNVTSQAQAQWASPAGVDDCAMNSEMLNNQQLAIDEGTISLSSQYSQQLLGTLTHALESSGVDLSQASISVQINLGKRAVKRPGADGSSSSKELPSTSANNENMGHQLTMLGGGTEELPHPTKRHKSGNS

SEQ ID NO: 18289 - protein, 427 aa, Batrachospermum pseudogelatinosum
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFAIEGVNRAQAAAGEIKGHYLNVTAGTMEEIYERAAFAKELGSIICMVDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILKDAAKTCGPLQTALDLWKDISFNYTSTDTADFV

SEQ ID NO: 18290 - protein, 335 aa, Haemophilus somnus 2336
MKTLGQFIVEKQAEYPNAKGELSGILSSLRLVAKIIHRDINKAGLTNNIIGNSGVENVQGETQMKLDLFAHNTMKQALITREEVAGFASEEEENFVAFDTERGRNAKYVILTDPLDGSSNIDVNVAVGTIFSIYRRVSPIGTPVTLEDFLQPGHKQVAAGYIVYGSSTMLVYTTGNGVNGFTYDPSLGVFCLSHENIQIPPNGKIYSINEGQYLKFPMGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 18291 - protein, 474 aa, Cryptonemia borealis
RYESGVIPYAKMGYWDPDYVVKETDVLALFRVTPQPGVDPVEASAAVAGESSTATWTVVWTDLLTACDLYRAKAYKVDAVPNSSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQTMGIWARKNDMILHLHRAGNSTYSRQKSHGMNFRVICKWMRMAGVDHIHAGTVVGKLEGDPLMIRGFYNTLLFTHLDVNLPQGIFFEQDWASLRKVTPVASGGIHCGQMHQLLDYLGNDVVLQFGGGTIGHPDGIQAGATANRVALETMVIARNEGRDYVAEGPQILQDAAKTCGPLQTALDLWKDITFNYTSTDTADFVETPTANV

SEQ ID NO: 18292 - protein, 181 aa, Arabidopsis thaliana; identical to SEQ ID NO: 3456

SEQ ID NO: 18293 - protein, 323 aa, Enterococcus faecium
MKIINFEEVVASFSFEEAIQVMKKCFFDYESGKISQNPRLVEILPDGKDKNMFAMMPAYLGENRYFGTKVITAFPDNHQYHLPSHLGEIFLFDAQNGLPKALINANAVTWIRTAAVSALATDYLANPHAETLALIGAGQQALSHLTAISTIRPITTVFVYDILEERRNTFIAKAKKQYPKITFINAISVEDAVRPAEIICTLTSSKEAFLQKEWVREDAHINAVGTFTPDTREISTSLMETSQIYVDDYSATLTESGDLLIAMAEGDLEESCIVGTLGELVSEKKTFYKGESRPTIFDAVGLAIEDLCCAEYIYNKLEKGALK

SEQ ID NO: 18294 - protein, 361 aa, Zea mays
MARATNAHHHRLRLLLCLSLAAAAWAHGGGGDSDADADADADGGAAARPDLRARSLVEAKLWCLAVVFVGTLLGGVSPYFMRWNEAFLALGTQFAGGVFLGTALMHFLSDANETFGDLLPDSGYPWAFMLACAGYVVTMLADVAISYVVSRSQGRSTGTAATGGSDAGLEEGKMRTTNGTRSEPTPADAHGSDHSAASILRNASTIGDSVLLIVALCFHSVFEGIAIGIAETKADAWKALWTISLHKIFAAIAMGIALLRMLPNRPLLSCFAYAFAFAISSPVGVGIGIIIDATTQGRVADWIFAVSMGLATGIFVYVSINHLLSKGYRPQRPVAVDTPVGRWLAVVFGVAVIAVVMIWDT

SEQ ID NO: 18295 - protein, 183 aa, Pyrus pyrifolia
MASSMISSGTVATVSADRPAPAQARMVAPFNGLKSSSAFPVTRKSNDITSIASNGGRVQCMQVWPPLGLKKFETLSYLPPLSSESLAKEVDYLLRKNWVPCLEFELETGFVYRENHRSPGYYDGRYWTMWKLPMFGCTDSSQVLKELEEAKKAYPQSFIRIIGFDNVRQVQCISFIAYKPAGF

SEQ ID NO: 18296 - protein, 457 aa, Glycine max
MKRLVSNCAFTHNIKHCSGRQWRRNDHEPCKEKVLDPRPHSVSILEFGAVGDGKTLNTVAFQNAVFYAKSFADKGGAKLYVPSGKWLTGSFNLTSHLTLFLERGATIIASQDYAHWTAMDPLPSYGRGIDVPVGRYRSLIYGQNLSDVVITGDNGIIDGQGSVWWDLISTHSLNYSRPHIIELVGSDNIIISNLTFLNSPAWSIHPVYCSNIQIQKITVQAPTKFPYTSGIVPDSSEHVCIDNCNISTGHDAIVLKSGWDEYGVAYGKPTSNVHIRGVYLQSSSGAGLAFGSEMSGGISDIIAEQLHITNSTFGIELKTTRGRGGYMKNIFISDAKLENIYLGISMTGSSGSHPDDKYDPNAVPDVGNVTFENVIGANIAIAGNFSGIVDSPFTPICLSNVTFSTSSESSPSWFCSNVMGISKEVFPEPCPDLQNTYSNFSSCFSSLHPSSSFVSSA

SEQ ID NO: 18297 - protein, 310 aa, Phytophthora infestans
MSALTQYKPVATSEKKSGAMSFLLDLAAGGVAGGISKTVVAPIERVKLLLQVQAASTQIKPEDQYKGIVDCFVRVTKEQGVNSLWRGNLANVIRYFPTQALNFAFKDKFKKLFMDGVTKEQFWRFFMGNLASGGAAGATSLLFVYPLDFARTRLGADVGKGKSRMYTGLVNCVSTIYKSDGISGLYQGFGVSVGGIIVYRAAFFGGYDTLRDVALRDPKNAPVWQKWLVAQTVTSLAGMISYPFDTVRRRMMMQAGRKDILYTSTLDCAMKIAKNEGSGAFFKGAGSNILRGTGGAIVLVLYDEFKKMMV

SEQ ID NO: 18298 - protein, 473 aa, Prochlorococcus marinus subsp. pastoris str. CCMP1378
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGEPYNRCPRSLAQKALKYLDSTGIADTAFFGPEPEFFLFDDVRYDSKEGSCFYSVDTIEAPWNTGRTEEGGNLGYKIQYKEGYFPVAPNDTAQDIRSEMLLQMAELGIPTEKHHHEVAGAGQHELGIKFDSLISSADSVMTYKYVVRNVAKKYGKTATFMPKPVFNDNGTGMHVHQSLWESGQPLFYGEGSYANLSQTARWYIGGILKHAPSFLAFTNPTTNSYKRLIPGFEAPVNLVYSEGNRSAAVRIPLTGPNPKAKRLEFRSGDALANPYLAFSVMMLAGIDGIKNQIDPGDGVDVDLFELPAEELSKIDTVPSSLNDSLNALKADKDYLLAGGVFTEDFIDNFIDMKYEEVQQLRQRPHPHEFFMYYDA

SEQ ID NO: 18299 - protein, 474 aa, Ptilophora subcostata
  unsure (1)..(474): unsure at all Xaa locations
RYXSGVIPYAKMGYWDPDYIVKETDVLALFRITPQPGVDSVEASAAVAGESSTATWTVVWTDLLTACDLYRAKAYKVDPVPNSSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIVMIDLVIGYTAIQTMAVWARKNDMILHLHRAGNSTYSRQKSHGMNFRVICKWMRMAGIDHIHAGTVVGKLEGDPLMIRGFYNTLLFSHLDVDLPKGIFFEQNWASLRKVTPVASGGIHCGQMHQLLDYLGVDVILQFGGGTIGHPDGIQAGATANRVALEAVVIARNEGRDYVAEGPQIFRDAAKTCGPLQTALDLWKDITFNYTSTDTADFVETPTANV

SEQ ID NO: 18300 - protein, 505 aa, Populus tremuloides
MDLLLLEKTLLGSFVAILVAILVSKLRGKRFKLPPGPLPVPVFGNWLQVGDDLNHRNLTDLAKKFGDILLLRMGQRNLVVVSSPELSKEVLHTQGVEFGSRTRNVVFDIFTGKGQDMVFTVYGEHWRKMRRIMTVPFFTNKVVQQYRYGWEEEAAQVVEDVKKNPGAATHGIVLRRRLQLMMYNNMYRIMFDRRFESEEDPLFNKLKALNGERSRLAQSFDYNYGDFIPILRPFLRGYLKICQEVKERRLQLFKDYFVDERKKLASTKNMCNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTSEKGGQFSLHILKHSTIVAKPRSF

SEQ ID NO: 18301 - protein, 120 aa, Glycine max
MMSVLLTLVMTPHSIIFVLTLGNGVFVFTLDPMYGEFVLTQENLQIPRAGKIYAFNEGNYQLWDDKLKKYIDDLKDPGPSGKPYSARLLYECAPMSFIVEQAGGKGSDGHQRILDIQPTE

SEQ ID NO: 18302 - protein, 219 aa, Zea mays; identical to SEQ ID NO: 14443

SEQ ID NO: 18303 - protein, 373 aa, Oryza sativa
MAKNTCKLCYRRFGNPRALAGHMRSHSVAASRSQISSTSSASTSVAVGDDDGGGDAKRPIQGYVLREKPKRRVRLAESDFSDRESETEYYSSPPHGKRANTGSGDVEQVSSVSDATSEEDVALSLMMLSRDTWPATPPPPPPYRLRGAGYDDGSDGGDAPPAPAAAAAQKRTRFQCPACKKVFRSYQALGGHRASHMRGGRGGCCAPPPNPPPSPATPLQPLPECDGGEEEGAKPHPHECPYCFRVFASGQALGGHKRSQLCSAAAAAASGDDIPAMIKSNGFIDLNLPAPFDDVELSAVSDPFLSSKPAVLVPIVHGTGFGQTIGEIGAATAAFCSCFLSSLLPLPTTTTTCLPGLAAAYAAVTASPLPFSR

SEQ ID NO: 18304 - protein, 348 aa, Staphylococcus aureus subsp. aureus MW2
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGKDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 18305 - protein, 360 aa, Paracoccidioides brasiliensis
MGVKDILSRKTGVIVGDDVLRLFQHAQEKVFAIPAINVTSSSTVVAALEAARDKNSPIILQVSQGGAAFFAGKGVPNGKQEASVAGAIAAAHYIRSIAPSYGIPVVLHTDHCAKKLLPWLDGMLDADECYFKLHNEPLFSSHMIDLSEESVEWNIETTAKYLKRAAPMKQWLEMEIGITGGEEDGVNNESVDNNSLYTQPEDIYTIYKTLSAISPYFSIAAGFGNVHGVYKPGNVRLHPELLSKHQAHVKEKTGSSKNKPVYLVFHGGSGSTKAEFKEAISYGVVKVNLDTDLQYAYLSGVRDFVLKKKDYLMSAVGNPEGEDKPNKKYFDPRVWIREGEKTMCARVQEAFDDFNTSNQL

SEQ ID NO: 18306 - protein, 504 aa, Glycine max
MSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPGFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSLQGPQADRNQLEKILSYIEHGKREGATLLTGGNTVGNKGYYIEPTIFCNVKEDMLIARDEIFGPVLALMKFKTMEEAIKSANNTKYGLAAGIVTKNLDTANTMSRSIRAGIVWINCYLTVGSDVPFGGYKMSGFGRDLGLQALHKYLQVKSVVTPIHNSPWL

SEQ ID NO: 18307 - protein, 388 aa, Triticum aestivum
  unsure (1)..(388): unsure at all Xaa locations
NGFESKVIDRNRANLAQPKHTQPTPTPAPAQAAGTRTRAGIRRRRGEGRPRSGCYLLGLAALGDAAAGGGDVWINERRFRVLRHFAEGGFAFVYLVTAHAAPXATRATVTHDTTHDNEKYAMKKVLIRSRELLDLVKEEIRVSSXLFNHPNLLPLLDHAIIAVKSTQGDWSHEAYLLFPVHLDGTLFDNAAVMQSRKEFYSVVDVLRIFQQICEGLKHMHSLDPPYAHNDVKPGNVLVTCRKGQAPLATLMDFGSSRPARNQIRSRSEALRLQEWAAEHCSAPFRAPELWDCPSHADIDERTDIWSLGCTLYAIMYGVSPFEYALGESGGSLQLAIMNAQLKWPALPSTYPDALHKFVTWMLQPQPEMRPRINDILLHVDKLVEKYSP

SEQ ID NO: 18308 - protein, 478 aa, Caulobacter crescentus CB15
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 18309 - protein, 473 aa, Acrosorium sp. 2
YESGVIPYAKMGYWDPDYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEEMYERAEFAKQLGTIIVMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFQQDWASLRKVTPVASGGIHCGQMHQLLDYLGNDVVLQFGGGTIGHPDGIQAGATANRVALESMVIARNEGIDYVSEGPQILRDAAKTCGPLQTALDLWKDITFNYTSTDTADFVETPTANV

SEQ ID NO: 18310 - protein, 325 aa, Escherichia coli CFT073
MVSLTYIDEKTKQYAEGKMGSTRKGMLNVLIAAVLWGSSGVCAQYIMEQSQMSSQFLTMTRLIFAGLILLTLSFIHGDKIFSIINNHKDAISLLIFSVVGALTVQLTFLLTIEKSNAATATVLQFLSPTIIVAWFSLVRKSRPGILVFCAILTSLIGTFLLVTHGNPTSLSISPAALFWGIASAFAAAFYTTYPSTLIARYGTLPVVGWSMLIGGLILLPFYARQGTNFVVNGSLILAFFYLVVIGTSLTFSLYLKGAQLIGGPKASILSCAEPLSSALLSLLLLGITFTLPDWLGTLLILSSVILISMDSRRRARKINRPARHE

SEQ ID NO: 18311 - protein, 233 aa, Staphylococcus epidermidis ATCC 12228
MTGKHKRAIEDHFDNQKELEMVLENKGKADLLEKVQYSTDLANIFYVRQKEQKGLGHAIHTAKQFIGNEPFAVLLGDDIVESDTPAIKQLMDVYEETGHSVIGVQEVPESDTHRYGVIDPSAKEGSRYEVRQFVEKPKQGTAPSNLAIMGRYVLTPEIFDYLETQQEGAGNEIQLTDAIERMNSKQQVYAYDFEGNRYDVGEKLGFVKTTIEYALKDPEMSQDLKAFIKQLDI

SEQ ID NO: 18312 - protein, 453 aa, Thermoactinomyces vulgaris
LSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRQIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 18313 - protein, 537 aa, Nicotiana tabacum
MAKDQLQVLNALDVAKTQLYHFTAIVIAGMGFFTDAYDLFCISLVTKLLGRIYYHHDGAPKPGTLPPNVSAAVNGVAFCGTLAGQLFFGWLGDKMGRKRVYGMTLMMMVICSIASGLSFGHTPKSVMTTLCFFRFWLGFGIGGDYPLSATIMSEYANKKTRGAFIAAVFAMQGFGILAGGMVAIIVSAAFKGAFPAQTYQTDPLGSTISQADFVWRIILMFGAIPAAMTYYWRMKMPETARYTALVAKNLKQAANDMSKVLQVDIEEEQEKVENVSQNTRNEFGLFSKEFLRRHGLHLLGTASTWFLLDIAFYSQNLFQKDIFSAIGWIPPAQTMNALEEVYKIARAQTLIALCSTVPGYWFTVFFIDKIGRFAFQLMGFFFMTVFMFALAIPYHHWTLKDNRIGFVIMYSLTFFFANFGPNATTFVVPAEIFPARLRSTCHGISAAAGKAGAMIGAFGFLYAAQPTDRKKADAGYPAGIGVRNSLIVLGCVNFLGMVFTFLVPESKGKSLEEMSRENEGEEESGTEMKNSGRTVPV

SEQ ID NO: 18314 - protein, 354 aa, Sporothrix schenckii
MCFGGRSKADEDVARSRELDKAIRADEKRMSREVKLLLLGAGESGKSTVLKQMKLIYAKGFSKNERLEWKPVVFNNIVQSFRLIYDAMAELDISFSDPENEKNIKQILVEFELGANDPLPTDYLEPIKTLWKDDGVRRAIAKGNEFALHDNLDYFCEDLDRIWDRTYVPNDQDLLRSRLRTTGITETVFDLGQLTYRMFDVGGQRSERKKWIHCFENVNCLLFLVAISGYDQCLVEDKDGNQMSEALMLWESIANSHWFTKSSLILFLNKMDLFKEKLPNSPIAEHGFTDYSGPAADPKQVSKYFMDKFRALNRNPEKEIYGHFTNATDTNLLKITMGSVQDMIIQRNLKQLIL

SEQ ID NO: 18315 - protein, 171 aa, Streptococcus mutans
ANISEQISLASKEASGTSNMKFMMTGAVTLATLDGANIEIKDEVGDENIVIFGMTKDDVYRHYENHDYYSRGVYESNPVIKRVVDTFINGTIPNSQSEGTEIYEALITHNDEYFLLEDFIAYVQAQEKIDALYRDKETWSRMSLCNIANSDKFTSDDTITQYAKEIWHLEI

SEQ ID NO: 18316 - protein, 647 aa, Brassica napus
MSSAPSPGTGSPPSPPSNSTTTTPPPASAPPPTTPSSPPPPSTIPTSPPPSSRSTPSAPPPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 18317 - protein, 349 aa, Methylobacterium extorquens
MGAGSEAGKPAAETDAPQHRPAPNIPQFTKDEDLHAYREMLSIRRFEEKAGQLYGMGLIGGFCHLYIGQEAVVVGMQMAGEDGDQNITGYRDHGHMLACGMDPKGVMAELTGRRGGYSRGKGGSMHMFSREKQFFGGHGIVGAQVALGTGLAFADAYLKNGKVSFTYMGDGAANQGQVYESFNMAALWKLPVVYVIENNRYAMGTSVARASAQTDFSKRGLSFGIPGEQVDGMDVRTVREAAARAINHARSGEGPYILEMQTYRYRGHSMSDPAKYRTKDEVSKMRDEHDPIEMVRKRLLEAHGVPEAELKSIDAKVREIVNESADFATHDPEPDPSELWTDILLEARA

SEQ ID NO: 18318 - protein, 337 aa, Vibrio parahaemolyticus RIMD 2210633
MTRKHIYIAYTGGTIGMLKSDHGYVPIAGFMEKQLASMPEFHRPEMPEYTIHEYDPLIDSSDMTPADWQQIADDIRDNYDKYDGFVILHGTDTMAYTASALSFMLENLGKPVIVTGSQIPLAELRSDGQANLLNALHIAANYPINEVTLFFNNQLMRGNRSTKSHADGFNAFTSPNLPPLLEAGINIQISNSIKVNAQPEGEFKVHNITPQPIGVITMYPGISHEVIRNTLLQPVNAMILLTFGVGNAPQNPELLGHLKEASERGVIVVNLTQCLAGKVNMGGYATGCALADAGVISGYDMTPEAALAKLHFLLSQNLSYEEVKEKMQEVLRGEMSL

SEQ ID NO: 18319 - protein, 434 aa, Eremothecium gossypii
MPLLQQNPPIQPPYSRASQKLKSLLSSYGENTSTTTAAKEMNGIAPMNLIEKSVVHPPRTIYTKANFSIPGHYEVLQMLGKGSYGTVVSAIDNLNANYPIRIAIKKITNIFQREVLLKRAIRELKFMHYFKGHKNIVSLINLEIVNEKPYDGLYCYQELIDYDLARVIHSNVQFSEFHIKHFTYQILCGVKYIHSADVIHRDLKPGNILCSISGQLKICDFGLARGISPLFTNTKTSNHITNYVATRWYRAPELILSHKRYNKSIDMWAIGCILAEFYGRKPIFMGQDSMHQISEIVKVLGTPSRDTIIKYGSSRAYDIFCPPKPQYAKIPWAEIYPFAGPDALDLIERLLDWDPDRRLTVEEAIEHDFVKSVRDVNDEPCCPHGPFNFSYEAEFKSMSNLREVLYAEVKQFQEECATKDVVPSLPIPQQIYPI

SEQ ID NO: 18320 - protein, 288 aa, Azospirillum brasilense
MKGIILAGGSGTRLYPLTQVTSKQLLPVFDKPMIYYPLSTLMLAGIRDILIITTPQDQSQFQRLLGDGSQWGISLTYAEQPNPEGLAQAFLIGREFVGTDSVCLILGDNIFFGHDLEPALVRAAGRTDGATVFGYHVRDPERYGVVSFDAEGRPNAIEEKPVQPKSNYAVTGLYFYDNSVLDVAATIKPSPRGELEITDVNNVYLEQRRLAVEKLGRGYAWFDTGTHQSLLQAAEFVQTIEARQGLKIASPEEIAWRKGFIDGEQLARIARPLAKSGYGSYLLHLLTE

SEQ ID NO: 18321 - protein, 440 aa, Mycobacterium tuberculosis H37Rv
MRRPLDPRDIPDELRRRLGLLDAVVIGLGSMIGAGIFAALAPAAYAAGSGLLLGLAVAAVVAYCNAISSARLAARYPASGGTYVYGRMRLGDFWGYLAGWGFVVGKTASCAAMALTVGFYVWPAQAHAVAVAVVVALTAVNYAGIQKSAWLTRSIVAVVLVVLTAVVVAAYGSGAADPARLDIGVDAHVWGMLQAAGLLFFAFAGYARIATLGEEVRDPARTIPRAIPLALGITLAVYALVAVAVIAVLGPQRLARAAAPLSEAMRVAGVNWLIPVVQIGAAVAALGSLLALILGVSRTTLAMARDRHLPRWLAAVHPRFKVPFRAELVVGAVVAALAATADIRGAIGFSSFGVLVYYAIANASALTLGLDEGRPRRLIPLVGLIGCVVLAFALPLSSVAAGAAVLGVGVAAYGVRRIITRRARQTDSGDTQRSGHPSAT

SEQ ID NO: 18322 - protein, 163 aa, Triticum aestivum
QGENEDVTEEAVSTTLKRALSTFSTLQAHDGYWPGDYGGPMFLMPGLLIMLHVTGAMNTVLSPEHQKEIRRYLYNHQNEDGGWGLHIEGPSTMFGSALTYVSLRLLGEGPDSGDGAMEKGRNWILDHGGATYITSWGKFWLAVLGVFDWSGNNPLPPEIWMLP

SEQ ID NO: 18323 - protein, 414 aa, Pyrobaculum aerophilum str. IM2
MRGFKALTPIAEAQKVVLSALRHTPTVERIPTPSAVGLYAAEDVASPIDVPPFDRAAFDGYAVRSADTLGASRTNPILLRIVGKVLPGGEYPSELKPGEAVEIATGAPLPKGADAVVPYEEAAARGEYVEVYKPVPVFYYVSRRGEDVAAGEVVVKKGRRIKPWDVGVLTSVGIREVSVFKISAAIISTGNELVELEDAPPPPGKIVNSTRHVISALLRELGAESFYLGLVPDDEEAIYNAVREALAKFDIVITTGGVSVGEPDYVIKAVSRLRPEVLVHGIAARPGRPNSAAVVRGKPIVMLSGFPVASIVGFEVFVKPIILHMVGAKEEPAPVVRAVLTRRVTTPINVRSFVRVRVFRKGGVLYAEPLAVTGSGVLSTLTRGNGLLVIPENREGYDEGDEVDVILLAPVEDA

SEQ ID NO: 18324 - protein, 815 aa, Salmonella typhimurium LT2
MNAPFTYASPTLSVEALKHSIAYKLMFTIGKDPVIANKHEWLNATLFAVRDRLVERWLRSNRAQLSQETRQVYYLSMEFLIGRTLSNALLSLGIYDDVKGALEAMGLDLEELIDEENDPGLGNGGLGRLAACFLDSLATLGLPGRGYGIRYDYGMFKQNIVDGRQKESPDYWLEYGNPWEFKRHNTRYKVLFGGRIQQEGKKARWIETEEILAVAYDQIIPGYDTDATNTLRLWNAQASSEINLGKFNQGDYFAAVEDKNHSENVSRVLYPDDSTYSGRELRLRQEYFLVSATVQDILHRHYQLHKTYENLADKIAIHLNDTHPVLSIPELMRLLIDEHKFSWDDAFEVCCQVFSYTNHTLMSEALETWPVDMLGKILPRHLQIIFEINDYFLKTVQEQYPNDTSLLGRASIIDESNGRRVRMAWLAVVVSHKVNGVSELHSNLMVQSLFADFAKIFPTRFCNVTNGVTPRRWLALANPPLSDVLDENIGRTWRTDLSQLSELKQHCDYPLVNHAVRQAKLENKKRLAVVIAQQLNVVVNPKALFDVQIKRIHEYKRQLMNVLHVITRYNRIKENPEADWVPRVNIFAGKAASAYYMAKHIIHLINDVAKVINNDPQIGDKLKVVFIPNYSVSLAQVIIPAADLSEQISLAGTEASGTSNMKFALNGALTIGTLDGANVEMQEHIGEENIFIFGNTAEEVEALRRQGYKPRDYYEKDEELHQVLTQIGSGVFNPEEPGRYRDLVDSLINFGDHYQVLADYRSYVDCQDKVDELYRRPEEWTTKAMLNIANMGYFSSDRTIKEYAENIWHIDPVRL

SEQ ID NO: 18325 - protein, 464 aa, Zea mays
MSGVGSGRPPAAQKILQSLRPPLSFATAVAGRPFAAPDDYHRFPTPAAATAPAATSGGVGAGAPPRDTIEEGLVIRTPLKRKATSEENDAAAEPSDCIITSPMPTSVSGKTVKASKAKAKNSKTGPQTPTSNVGSPLNPPTPVGTCRYDSSLGLLTKKFINLLKQAPDGILDLNNAAETLEVQKRRIYDITNVLEGIGLIEKTLKNRIRWKALDDSSVQLDNGISALQAEVENLSLQEQALDERISDMREKLRGLTEDENNKRWLYVTEDDIKGLPSFQNETLIAIKAPHGTTLEVPDPDEAGDYLQRRYRIVLRSTMGPIDVYLVSQFDEKFEELGGVATPVKHSNVPRHQPVEDFNTYAGQSSTPMDVAHDVQHGQKIPQDPSALHDFGGMTRISPSDVHTDSDYWLLTEGDVSMTDMWKTGQEVQWDQIDFLSEDVVTPRAHNQQPVTVDGPHMEVPSMDP

SEQ ID NO: 18326 - protein, 278 aa, Cladonia mitis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 18327 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRRSLEEMLADKQYLKEGQ

SEQ ID NO: 18328 - protein, 403 aa, Triticum aestivum
  unsure (1)..(403): unsure at all Xaa locations
SIIKQALAVGCFPRVKIIHTSKKYLGQIYSPDINWILMVLCIAVTAGFKNQSQIANAYGTAVIMVMRGTTFLMIPIMLLVWRSRWASARRFTVLSLAVEIPYLTAVLKKIDQGGWVPLVFAAAILLVMYVWHYGTLKRYEFEMHSKVSMAWILGLXGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFIRLESMMEEYSDSDEYSALDQQELIDEASSDARSAADLSYASRDSIVPVRSPNHLGAMSSAQATTATPGFETVGDEVTFLNSCRDAGVVHILGNTVIRARRDSGPLKKLAIDYLYAFLRKICRENSAIFNVPHESLLNVGQVFYV

SEQ ID NO: 18329 - protein, 68 aa, Triticum aestivum
  unsure (1)..(68): unsure at all Xaa locations
TTNVIIHSNGLSFCTNRQVRFVKRFVEALSEGRVTXHEIRSIWISYWSQADKSLGQKLATRLNVRPNF

SEQ ID NO: 18330 - protein, 131 aa, Flaveria ramosissima
SNGGRVQCMKVWPPLGKKKYETLSYLPDLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 18331 - protein, 267 aa, Candida albicans
MANEEYVTDSSSDFTEYWIDLFLGIKGNEYFCDIDDEYIRDRFNLTGLNSEVSKLPTLIDIITDVIDIELQPEEHKDSLEHNARILYGLIHARYILTTRGLNKMFEKFRSGDFGYCPRVHCQLNPLLPIGLNDQPRMASVKLYCSKCEDLYNPKSGRHSAIDGAYFGTSFPAMFFQNFPNTVPIHAKETYVPRVFGFKLHEYSKLNRWRELQRLKLENRLKKNGIQIDNVVGGFITNGDEEEKQDNNNNKQLQSVSSQFKSLSPNQK

SEQ ID NO: 18332 - protein, 368 aa, Sordaria macrospora
MATHNIVVFGGDHCGPEVVVEAIKVLKSIETNSPSAGKFNLQNHLLGGASIDKHHDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIERIARLAGFLALAKNPPAKVWSLDKANVLATSRLWRKTVTDVISKEFPQLQLEHQLIDSAAMLLVKNPRALNGVVITSNLFGDIISDEASVIPGSIGLLPSASLGGIPDGKGKCNGIYEPIHGSAPDISGKGIVNPVGTILSVAMMLRYSLNLPKEADAVEAAVKAAIDNGTKTKDLGGSATTSDMGNAVVAELEKILKA

SEQ ID NO: 18333 - protein, 241 aa, Sinapis alba
MGRGRVQLKRIENKINRQVTFSKRRSGLLKKAHEISVLCDAEVALVIFSSKGKLFEYSTDSCMEKILERYDRYLYSDKQLVGRDISQSENWVLEHAKLKARVEVLEKNKRNFMGEDLDSLSLKELQSLEHQLHAAIKSIRSRKNQAMFESISALQKKDKVLQDHNNALLKKIKEREKNTVHQEVQLIQCSNNSSILQPQYCLTSSRDGFVGRVEGENEGASSLAEPNSLLPAWMLRPTTNE

SEQ ID NO: 18334 - protein, 389 aa, Guillardia theta
MNCYCLYVGDLNVSLKDIDLERIFRKDYEISGLRICKDIFSGNSLGYSYVYFNSYSSAKKALNDMNFYSDTELFKTPIRIMWKNNNNSIRKSGYGNLFIKNLPYNFSPKDLHSLFSEYGEILSSKIKYDNEGSSLGYGFVHYKEMKDAISAINNLNGKLISNKMITVKHFLNKSQRERISSCDLFTNIYVKNLPVDKLSEKVIFNLFGVFGKITSIFIPLWYNSIPKGFAYINFENHEDAEEAIITMNNRKIAGKSLIVCKAINKIKIDTINKKSRNYCMNNSLLINKLEYNQKKNIGSDIENSSNSSKADKSILIEIFSSKINYQYMHKIIIINLIYMSLKNNCKLNVEKILNLFIKLKSKDIEKIIFMKKSKKKKILINFKNKYLKI

SEQ ID NO: 18335 - protein, 1196 aa, Paenibacillus polymyxa
MTLYRSLWKKGCMLLLSLVLSLTAFIGSPSNTASAAVADDFQASVMGPLAKINDWGSFKKQLQTLKNNGVYAITTDVWWGYVESAGDNQFDWSYYKTYANAVKEAGLKWVPIISTHKCGGNVGDDCNIPLPSWLSSKGSADEMQFKDESGYANSEALSPLWSGTGKQYDELYASFAENFAGYKSIIPKIYLSGGPSGELRYPSYYPAAGWSYPGRGKFQAYTETAKNAFRTAMNDKYGSLDKINAAWGTKLTSLSQINPPTDGDGFYTNGGYNSAYGKDFLSWYQSVLEKHLGVIGAAAHKNFDSVFGVRIGAKISGLHWQMNNPAMPHGTEQAGGYYDYNRLIQKFKDADLDLTFTCLEMSDSGTAPNYSLPSTLVDTVSSIANAKGVRLNGENALPTGGSGFQKIEEKITKFGYHGFTLLRINNLVNNDGSPTGELSGFKQYIISKAKPDNNGGTGNKVTIYYKKGFNSPYIHYRPAGGSWTAAPGVKMQDAEISGYAKITVDIGSASQLEAAFNDGNNNWDSNNTKNYSFSTGTSTYTPGNSGNAGTITSGAPAGANPGDGGGTTNKVTVYYKKGFNSPYIHYRPAGGSWTAAPGVKMQDAEISGYAKITVDIGSASQLEAAFNDGNNNWDSNNTKNYLFSTGTSTYTPGSNGAAGTIRTGAPSGSVLSVVTSTYATDLNEVTGPIQTEKLSGVSLNVSTSTYAPNSNGVEVTAQTEAPSGAFTSMDLGTLSNPTSLNTDWSKQSIYFIMTDRFSNGDPSNDNYGGFNSNNSDQRKWHGGDFQGIINKLDYIKNMGFTAIWITPVTMQKSEYAYHGYHTYDFYAVDGHLGTMDKLQELVRKAHDKNIAVMVDVVVNHTGDFQPGNGFAKAPFDKADWYHHNGDITDGDYNSNNQWKIENGDVAGLDDLNHENPATANELKNWIKWLLNETGIDGLRLDTVKHVPKGFLKDFDQAANTFTMGEIFHGDPAYVGDYTRYLDAALDFPMYYTIKDVFGHDQSMRKIKDRYSDDRYYRDAQTNGVFIDNHDVKRFLNDASGKPGANYDKWPQLKAALGFTLTSRGIPIIYQGTEQGYSGGDDPANRENMNFNANHDLYQYIAKLNYVRNNHPALQNGSQREKWVDDSFYSFQRSKNGDEAIVFINNSWNSQTRTIGNFDNLSNGTRLTNQLSNDSVQINNGSITVTLAPKEVKVFTK

SEQ ID NO: 18336 - protein, 457 aa, Zea mays; identical to SEQ ID NO: 14471

SEQ ID NO: 18337 - protein, 387 aa, Eremothecium gossypii
MDFDIKAVIRPNILKLKPYRCARDDFSEGILLDANENAFGPVVKFSRLPASLHRYPDPHQLELKGLLASYRNAASAFREEGLAPLTAKNICLGVGSDESIDAIIRATCSPREQKVMLLPPTYGMYKVCADINDVGYVEVPLISSDNSFQIDEDRILEQLNLDKSIKVVFITSPGNPTGACIEVGRVEKLLRNWTAGIVVVDEAYIDFSADKPSLSPLVNKHPNLVVLQTLSKASGLAGIRLGFTFASTQIATALNAMKAPYNISQITAIIGIEALQPEALKLMQKHIDQINTEKRRIIKALATLNHIENDPVGGLDANFILFRVRGGDNSLAKKLYYSLATESGVIIRFRGTDLGCEGCIRITVGTPEENDVLIKEFTEKLQQLTED

SEQ ID NO: 18338 - protein, 491 aa, Raphanus sativus
MDPYKYRPASSYNSPFFTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 18339 - protein, 296 aa, Oryza sativa
MAGLSLQHPWAFAFGLLGNLISFTTYLAPIPTFYRIYKSKSTEGFQSVPYVVALFSAMLWIFYALIKSNEALLITINAAGCVIETIYIVMYLAYAPKKAKVFTTKILLLLNVGVFGVILLLTLLLSHGEQRVVSLGWVCVAFSVSVFVAPLSIIKRVIQSRSVEYMPFSLSLTLTLSAVVWFLYGLLIKDKYVALPNILGFTFGVVQMGLYVFYMNATPVAGEGKEGKGKLAAAEELPVVVNVGKLAAATPDRSTGAVHVHPVPRSCAAEAAAAEPEVLVDIPPPPPPRAVEVAAV

SEQ ID NO: 18340 - protein, 216 aa, Zea mays
MSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSQRMDRNKWIIGGIITALALAIHFILY

SEQ ID NO: 18341 - protein, 156 aa, Oryza sativa
MAPSVMASTATTVAPFQGLKYTVGMPVARRSGNSSFGNVSNGGRIRCMQVWPLEGIKKFETLFYLPPFTVEDLLKQIEYLLRYKWVPCLEFSKVGYVYRENHRSPGYYDGRYWTMWKPAMFWCTYATHVLKELEEAMKAYPDAFVRIIGFDNVRHV

SEQ ID NO: 18342 - protein, 206 aa, Saccharomyces cerevisiae
MPSHRNSNLKFCTVCASNNNRSMESHKVLQEAGYNVSSYGTGSAVRLPGLSIDKPNVYSFGTPYNDIYNDLLSQSADRYKSNGLLQMLDRNRRLKKAPEKWQESTKVFDFVFTCEERCFDAVCEDLMNRGGKLNKIVHVINVDIKDDDENAKIGSKAILELADMLNDKIEQCEKDDIPFEDCIMDILTEWQSSHSQLPPLYAPSYY

SEQ ID NO: 18343 - protein, 193 aa, Serratia marcescens
MADILLLDNVDSFTYNLVDQLRASGHQVVIYRNQIGAEVIIERLQHMEQPVLMLSPGPGTPSEAGCMPELLQRLRGQLPIIGICLGHQAIVEAYGGQVGQAGEILHGKASAIAHDGEGMFAGMANPLPVARYHSLVGSNIPADLTVNARSGEMVMAVRDDRRRVCGFQFHPESILTTHGARLLEQTLAWALAK

SEQ ID NO: 18344 - protein, 510 aa, Zea mays
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEVSPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 18345 - protein, 160 aa, Glycine max
  unsure (1)..(160): unsure at all Xaa locations
HGYKREKNRSRKSGGSVDSWFSGELRGIGWNSYDSATGSGEIVAKSXXVSSTPSMRGTVFYVAPEYGYNGDASEKCDVYSXXXLLLVIVSGRRPLQVSGSAIWEYKRANLVSWARQCERRGKLLXVVDERVEGLDKEQASLCVTXRLMCLLKSPARRPFM

SEQ ID NO: 18346 - protein, 146 aa, Triticum aestivum
  unsure (1)..(146): unsure at all Xaa locations
TXNVLITQRKEQPHLAILMDFESARPARRAIRSQAEALQLQEWASEHCSAHFRAPELWECPPHADIDERTDVWXSPFDYELDESAGESLVTVIKSAQVKWPTETGSSYPDTLRQFVTWMLQPHPAVRPNIDDIIIHVDKLIAKHSI

SEQ ID NO: 18347 - protein, 196 aa, Zea mays; identical to SEQ ID NO: 11384

SEQ ID NO: 18348 - protein, 385 aa, Photobacterium profundum
MNVQALPMHRFIDHHGNLVSQLPAWADQSILKGFYCDMVLTRTYDNKAVALQRTGKLGTYPSHLGAEAIGIAIGRALRADDVFIPYYRDMPAMWARGIAMEKNLQYWGGDERGSDFCVTNDQTSTNFTTPNNTTQSPAHSPNHSHCRDLPFCVPIATQCTHAVGVASALKIEGGHKAALVTCGDGATSKGDFLESINCAGTWNIPLVFVVNNNQWAISVPRRLQCGADFLSEKAKGAGIPGLTVDGNDIVAMFDAVQISLDRARKGKGATLIEAISYRLGDHTTADDASRYRSEDELHEAWGFEPISRLKTYLMRQSLWSEQDDKQWQEHCQEVVEQAVKRYLNIPVQAPETAFDFLYESLNTELHQQRDELINKAMRMQGGKHG

SEQ ID NO: 18349 - protein, 524 aa, Aspergillus niger
MAPPKYAGMSGRPLSLFLSGIATMGFLLFGYDQGVMSGIISDAAFNNVFTATRNDNVMQATVTAVYEGCLVGAIFALIFGETLGRRLMVISGAWVMIIGVIIQVTAMPGHIPLLQFIFGRVITGIGNGMNTSTIPTYQAECSKSTNRGLLICIEGGIIAIGTAIAYWIDFGAHYGPPDLVWRFPIAFQIFFGILIIVGMMYLPDSPRYLIAHGKVEEGTRVLAALAGSEIDDPHVQLEKQLTLDSIRAFRDLLTGGPSQHFRRMIVGSSSQFFQQISGCNAVIYYLPVLLEQSIGQSHDFALLIGGVNMICYAIFATFSWFFIEKIGRRKLFLGGSYGQCAAMIIVFGCLIPGDSESAKGAVFGFFLYMCVFGATWLPLPWLYPAEISPLKTRSKANAVSTCSNWLFNFTVVMITPVMVQHIGWGTYLFFAAWNGLFIPVIWFFYPETAGRSLEEIDLIFAKGYVENMSYVRASKELPKLTDEEIEAKAAEYGILGDEEKAEERIAEKDPPASAEFSQFQPTQL

SEQ ID NO: 18350 - protein, 168 aa, Triticum aestivum
CLGCIFVQRESKCSDSKGVSGAVTERLHEVSQDENSPMILLFPEGTTTNGDYLLPFKTGAFLARAPLQPVILRYPCRRFSPAWDSMDGARHVFLLLCQFANYIEVVRLPVYYPSEQEKQDPRVYANNVRKLLATEGNLVLSNLGLAEKRAYHAALNGNSPRALHQKDD

SEQ ID NO: 18351 - protein, 205 aa, Triticum aestivum
MASGNRALPIENGEVLPAAGGNGEGGNGGSGDGFNRNRSSVDQQIDDMRRRLRELEETEREMLAAAAAATHEDPAAAVTALEKAEVDARSIYVGNVDYGCLPEEVQEHFQDCGTINRVTILTDFYGNPKGYAYVEFHEAEAVQNALQLNDTELHGRPLKVCPKRTNVPGMSHHRGRHPFQPYYPPYPAFGRSPRFRRSPRFYPYY

SEQ ID NO: 18352 - protein, 618 aa, Agrobacterium tumefaciens str. C58
MSSNRPSGSSISKAKAGWKQAMTDKDNTENSNRMTGAEIVLQALKDNGVEHIFGYPGGAVLPIYDEIFQQEDIQHILVRHEQGAGHAAEGYARSTGKVGVMLVTSGPGATNAVTPLQDALMDSIPLVCLSGQVPTSLIGSDAFQECDTVGITRPCTKHNWLVKDVNELAGIIHEAFRIAQTGRPGPVVVDIPKDIQFATGTYTPPSAAIQQKSYKPKVQGDLNAIHAAIELMSKAKKPVFYTGGGVINSGPEATRLLRELVELTNFPITSTLMGLGAYPASGKNWLGMLGMHGSYEANMTMHDCDVMVCIGARFDDRITGRINAFSPNSKKIHIDIDPSSINKTVRVDVPVIGDVGHVLEDMVRLWRALPKKPEKAQTADWWSQIERWRARNSFAYKNSKDVIMPQYALQRLYEASKGRDTYITTEVGQHQMWAAQFFGFEEPNHWMTSGGLGTMGYGLPAAIGVQVAHPEALVIDIAGDASIQMCIQEMSCAIQYGLPVKIFILNNQYMGMVRQWQQLLHGNRLSNSYTEAMPDFVKLAEAYGAVGMYCDDPKELDDKIAEMIAVNKPVIFDCRVANLANCFPMIPSGKAHNEMLLPDEATDEAVANAIDAKGRQLV

SEQ ID NO: 18353 - protein, 565 aa, Yersinia pestis CO92
MELEYESKRPLYIPYAGPILLEFPLLNKGSAFTNDERNHFNLHGLLPEAVETIEEQAERAYRQYQDFKNDDDKHIYLRNIQDTNETLFYRLLEAHLSEMMPIIYTPTVGEACEHFSDIYRRARGLFISYPNREHIDDMLQNATKQNVKVIVVTDGERILGLGDQGIGGMGIPIGKLSLYTACGGISPAYTLPVVLDVGTNNPQRLNDPLYMGWRHPRISGDEYYAFVDEFIQAVKRRWPNVLLQFEDFAQKNATPLLNRYRDELCCFNDDIQGTAAVTLGSLIAASHAAGSQLRDQTVTFLGAGSAGCGIAEQIIAQMMSEGLSEIQARARIFMVDRFGLLTDKLPNLLDFQSKLVQKSDDLHHWNLHNDAISLLDVVRNAKPTVLIGVSGQPGLFTEELIREMHSHCARPIVMPLSNPTSRVEARPEDIINWTDGAALVATGSPFPPVSYKEKLYPIAQCNNSYIFPGIGLGVLASGASRVTDGMLMAASRALAESSPLARHGEGALLPNIDDIQAVSKAIAMRVGQAAQLQGVAIVTSEEALSKAIEHNYWQPQYRSYKRTSF

SEQ ID NO: 18354 - protein, 211 aa, Oryza sativa
  unsure (1)..(211): unsure at all Xaa locations
RSRAARLADLITLPWPACVVVSKHAXPNSTSSASSRKPRTASVXTSNVVEAVRHVRSIMGEIRTLRDMDDDEVFAYAKRIAAPYDLVMQTKQLGRLPVVLFAAGGVATPADAALMMQLGCDGIFVGSSIFKSGDHARHARTIVQAITHCRSLRPSTLPPRRPRWHTFAVELCPGITDHSSCHNRRYQDIKGALILHYKTHLKQKLHFIAQV

SEQ ID NO: 18355 - protein, 482 aa, ASPERGILLUS NIDULANS FGSC A4
MDQKAQPEAEDGRTVAAGQEERSIVYRTYTHPWFQIFLISFICFCCPGMYNALTGLGGSGQVDPTVAANATVALLSATAGTALFVVGPIFDRVGPRICLLFGGWTYPLYAGSLLCFNRTGNGAFVIASGAILGIGASFLWVSQGAIMTTYVRESQKGRAIAAFWIIFNLGGGVGSLASFGLNYHSTSGTVSDGTYIALLILMAVGWLLGMLICPPSAVRLEELQQSSRTQTAVVETEKPNWKSTLRLAARTILDWRVLCMLPLFFCANVFYSYQQNIVNGMTFNIRTRSLNSALYWLAQMLGGLVMGLILDIPALTRPGRARAGWLFLAVTGLAIWGGGYAFEKWSSDRLAHGLKQDIDYTQGTVSTGPIFLYIFYGAFDAFWQSYCYWLMGARSNDPAVAAVLVGAYKTFQSTGGAMAWRINALDKPAMTQFAMDWGLCMGALVVAIPAVLTVTKTSTVDAEVAHQGEKGEEKTMSASVKG

SEQ ID NO: 18356 - protein, 192 aa, Serratia marcescens
ADILLLDNVDSFTYNLVDQLRASGHQVVIYRNQIGAEVIIERLQHMEQPVLMLSPGPGTPSEAGCMPELLQRLRGQLPIIGICLGHQAIVEAYGGQVGQAGEILHGKASAIAHDGEGMFAGMANPLPVARYHSLVGSNIPADLTVNARSGEMVMAVRDDRRRVCGFQFHPESILTTHGARLLEQTLAWALAK

SEQ ID NO: 18357 - protein, 396 aa, Triticum aestivum
  unsure (1)..(396): unsure at all Xaa locations
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLAVKLLLDSVEYSHVXSSACSEEGPELQDMAAPVEGAFMXDTHLPGGTILGVCPGDKLTGVTGADQAAAAMGIYGPRTPCGFCLGHLRPTPEFLVVALKDCPDTQEFILIDEGKWQHVKDTRTIGERKEYSHGDKRATFDNHDYDNPVNYYVNEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 18358 - protein, 463 aa, Yersinia pestis CO92
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 18359 - protein, 202 aa, Hypocrea jecorina
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNTKPSVHVGQGQGVGNSSSSSCC

SEQ ID NO: 18360 - protein, 338 aa, Zea mays
  unsure (1)..(338): unsure at all Xaa locations
MDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQGKRLGRPHGPRFKMKPQHFMAYTTKRNIDMTIXTEILTCQDEVVTRIEERISAWTFLPPENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPAIEGQKWSATKWIHVRSFDLTVKQPGPSDGCEDDNVLCPQWAAVGECAKNPNYMVGTKEAPGFCRKSCKVCAE

SEQ ID NO: 18361 - protein, 240 aa, Saccharomyces cerevisiae
MADEERLKEFKEANKIVFDPNTRQVWENQNRDGTKPATTFQSEEDIKRATPESEKDTSATSGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 18362 - protein, 398 aa, Oryza sativa
MAAAVVLLRRLRGVTAAPRRAAAALPLTTSVRGVSDSTEPLTIETSVPYKSHIVDPPPREVATTARELATFFRDMSAMRRAEIAADSLYKAKLIRGFCHLYDGQEAVAVGMEAATTRADAIITAYRDHCAYLARGGDLAALFAELMGRRGGCSRGKGGSMHLYKKDANFYGGHGIVGAQVPLGCGLAFAQRYRKEAAVTFDLYGDGAANQGQLFEALNMAALWKLPVVLVCENNHYGMGTAEWRASKSPAYYKRGDYVPGLKVDGMDVLAVKQACKFAKQHALENGPIILEMDTYRYHGHSMSDPGSTYRTRDEIAGIRQERDPIERVRKLLLAHDFATTQELKDMEKEIRKQVDTAIAKAKESPMPDPSELFTNVYVNDCGLESFGVDRKVVRTVLP

SEQ ID NO: 18363 - protein, 196 aa, Zea mays
HRVKKKKKEKKIEGPLKKYKKVHGNVDMAAAGDDATKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEAINLNESELHGRQIKVAPKRTNVPGMKQRPPRGYNSYHGYPYRSFGAPSFPPL

SEQ ID NO: 18364 - protein, 532 aa, Oryza sativa
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAGCLQQQQPSVTNPERTTSQRRKKSRVSLPLRSRSSRHKFDPHI

SEQ ID NO: 18365 - protein, 430 aa, Bacillus anthracis str. A2012
MTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLAFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 18366 - protein, 105 aa, Oryza sativa (japonica cultivar-group)
MAPGKLAVFALLASLLLLNTIKAADYPPAPPLGPPPHKIVDPGKDCVGACDARCSEHSHKKRCSRSCLTCCSACRCVPAGTAGNRETCGRCYTDWVSHNNMTKCP

SEQ ID NO: 18367 - protein, 405 aa, Pseudomonas aeruginosa UCBPP-PA14
MSGCCEQPGLMPVETALERLLELAAQTPIDTCEQVPLEQAGGRVLAVDLLAGLDLPPWPNSAMDGYALRLADWNGEPLPVSQKIFAGQAPEPLQAGTCARIFTGAPLPEGADLVEMQENAEALDDGRVRFTQPLRAGQHVRPRGQEIRQGDLVLPAGTRLRSIELGLAASLGCATLEVRRKPRVALLSTGDELVEAGQPLQAGQIYNSNRPLLKDWLQRLGCDVLDAGILPDDLARTRERLAGLAGVDLILSTGGVSVGEADFLGMALREAGELTLWKLAIKPGKPLIVGQFQGIPVIGLPGNPASTLVTFALLARPYLLRRLGVAQVAPLRVEVPAGFAWTKAGQRREYLRGRLEQGRAVLYPNQSSGVLRSASWAEGLVEVREGRTLVEGEGVAFIPLSELLD

SEQ ID NO: 18368 - protein, 478 aa, Enterococcus faecalis V583
MKNQHLTTSQGSPVGDNQNSLTAGEFGPVLIQDVHLLEKLAHFNRERVPERVVHAKGAGAHGIFKVSQSMAQYTKADFLSEVGKETPLFARFSTVAGELGSSDTLRDPRGFALKFYTDEGNYDLVGNNTPIFFIRDAIKFPDFIHSQKRNPRTHLKSPEAVWDFWSHSPESLHQVTILMSDRGIPLSFRHMHGFGSHTFKWVNAAGEVFFVKYHFKTNQGIKNLESQLAEEIAGKNPDFHIEDLHNAIENQEFPSWTLSVQIIPYADALTMKETLFDVTKTVSQKEYPLIEVGTMTLNRNPENYFAEVEQVTFSPGNFVPGIEASPDKLLQGRLFAYGDAHRHRVGANSHQLPINQAKAPVNNYQKDGNMRFNNGNSEINYEPNSYTETPKEDPTAKISSFEVEGNVGNYSYNQDHFTQANALYNLLPSEEKENLINNIAASLGQVKNQEIIARQIDLFTRVNPEYGARVAQAIKQQA

SEQ ID NO: 18369 - protein, 762 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPAKMWCYCRLVYMPMSYLYGKRFVGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFITNAVRFLEDTQTADGSWYGNWGVCFTYGSWFALGGLAAAGKTYTNCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 18370 - protein, 330 aa, Pseudomonas putida KT2440
MSEVLLLNQREIRECVTLDTDSIDVVENAFASLARGKVVMPSILRLDISEHNGEVDVKTAYLPDLENFAIKVSPGFFNNPGLGLPSLNGMMMLLSGRTGLLQALLLDNGYLTAVRTAAAGAVAARWLARQDSEEVALLGAGEQAELQLKALLLVRDIKRVRVWARSSAKAQQLALQLSSLYGLEATAAESVDEAMSSADIAVTCTPSNQPILHRRHLRPGLHITAMGADTEHKNEVAPEVIAAVDHYVADRVSQTATLGELHHAINAGVAQDLRVYAELGQVILGDRVGRLTPTDVTLCDLTGTGVQDTAIANLAFSRAISTGKGLLYNN

SEQ ID NO: 18371 - protein, 245 aa, Schizosaccharomyces pombe
KSFIKVSSLEQLKATGTVVVSDTGDFESIAKYKPQDATTNPSLILAASKKPQYAALVDAAVDYAKAKGGSINSQIEIAFDRLLIEFGTKILAIVPGRVSTEVDARYSFDTQTTIEKARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKNSVTRPLSWVLLSVTSVRSRNSLVLTF

SEQ ID NO: 18372 - protein, 351 aa, Triticum sp.
MSDVTAVMDLEVEEPQLALPPGFRFHPTDEEVVTHYLTRKVLRESFSCQVITDVDLNKNEPWELPGLAKMGEKEWFFFAHKGRKYPTGTRTNRATKKGYWKATGKDKEIFRGKGRDAVLVGMKKTLVFYTGRAPSGGKTPWVMHEYRLEGELPHRLPRTAKDDWAVCRVFNKDLAARNAPQMAPAADGGMEDPLAFLDDLLIDTDLFDDADLPMLMDSPSGADDFAGASSSTCSAALPLEPDAELPVLHPQQQQSPNYFFMPATANGNLGGAEYSPYQAMGDQQAAIRRYCKPKAEVASSSALLSPSLGLDTAALAGAETSFLMPSSRSYLDLEELFRGEPLMDYSNMWKI

SEQ ID NO: 18373 - protein, 489 aa, Glycine max
MALNLIHRPATKPPSSSSSFVTPRPLRTTQSIPVRNSRRSIAVRAAATEAPVATITAARECRVKSVKARQIVDSRGNPTVEVDLVTDGLFRAAVPSGASTGIYEALELRDGDKSVYGGKGVLNAVRNINEVLAPILVGVDVRNQADVDAIMLEIDGTPNKSKLGANAILGVSLSVCRAGAGAKGVPLYRHIQEISGTKELVMPVPAFNVINGGSHAGNNLAMQEFMILPVGATSFAEALRMGSEVYHVLKGIIKAKYGQDACNVGDEGGFAPNVQDNREGLVLLMDAIDKAGYTGKIKIGMDVAASEFYTKDGKYDLNFKKQPNDGAHVHSAQSLGQLYKDFVKEFPIVSIEDPFDQDDWGSWASLLASVDIQLVGDDLLVTNPKRIAEAIKKKACNGLLLKVNQIGTVTESIQAALDSKAAGWGVMVSHRSGETEDNFIADLSVGLASGQIKTGAPCRSERLAKYNQLLRIEEELGSVRYAGETFRSP

SEQ ID NO: 18374 - protein, 203 aa, Clematis integrifolia
KRRNGLLKKAYELSVLCDAEVALIVFSSRGRLYEYSNNSVRKTIERYKKASSDTSNTGSVSEANAQFYQNEAGKLRNQIASLQNNNKNLLGESLSNLSIRELKQLEKKIEGGITKIRSKKNELLFAEIEYMQKREIDLQNDNLYLRAKIADNERTQQQMNLMPGNEYEVISSAPFDSRNFLPVNLLEPNNSYSHCDQTTLQLG

SEQ ID NO: 18375 - protein, 251 aa, Zea mays
MSTAVARPAHGGFRQSGSGKPDPEDADRMRDANGYLVQEREKEEEERGGRALSEASSIGAASSDSSSIGENSASDKEGSDGEEEEVEGKAQGLGMMGLATLQSLDDALPTKRGLSNFYAGKSKSFTSLAEAAATAAAKEIAKPENPFNKRRRVLRAWSRRRASCSALATAYLPPLLAPDHAVVEEEDEEGADDEDEDEGQHGRGGLRGRRPPTFPSPRLSAHATAGQMARAGSFRSPRSFSMTDLHSAEYE

SEQ ID NO: 18376 - protein, 492 aa, Nicotiana plumbaginifolia
MDPYKYRPSSANNSPFWTTNSGAPVWNNNSSMTVGTRGPILLEDYHLVEKLANFDRERIPERVVHARGASAKGFFEVTHDITHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGVPQDYRHMEGSGVNTYMLINKAGKAHYVKFHWKPTCGVKCLLEEEAIKVGGANHSHATKDLYDSIAAGNYPEWKLFIQIIDPDHEDRFDFDPLDVTKTWPEDILPLQPVGRLVLNKNIDNFFAENEQLAFWPAIVVPGVYCSDDKLLQTRIFSYSDAQRHRLGPNYLQLPVNAPKCAHHNNHHEGFMNFMHRDEEVNYFPSRFDPCRHAEQYPIPPCVLTGKRDKCIIEKENNFKQPGERYRSWAPDRQERFICRWVDALSDPRVTHEIRSIWFSYWSQADKTLGQKIASRLNVRPTM

SEQ ID NO: 18377 - protein, 318 aa, Ralstonia metallidurans
MNELEQLRQFTTVVADTGDFQLMKQYKPQDATTNPSLIFKAVQKPEYRPLLEQAVRDHHGNSGLDGVMDQLLIAFGCEILAIVPGRVSTEVDARLSFDTEATVAKARHLIGLYEQRGVARERVLIKIASTWEGIRAAEVLQRENIRCNMTLLFSLAQAVACAEAGAQLISPFVGRILDWYKKQAGEKWDPVANGGENDPGVRSVRQIYDYYKKFGYATEVMGASFRGTDQILSLAGCDLLTISPELLEQLAGGQSAVALKLSVEQAQAGNVARIAADEPAFRWQLNEDAMATEKLSEGIRLFAADAVKLEKLVGELAS

SEQ ID NO: 18378 - protein, 339 aa, Photorhabdus luminescens
MTIKVAINGFGRIGRSILRALYESGRRAEIAVIAVNELADAEGIAHLLKYDSSHGRFAWDVRLNNDLLQVGDDNIRLFHQPDISTLPWQELGVDIVLDCSGIYGSRADGQAHLASGAKKVLFAHPGGNDLDATVVYGVNQHLLTAEDRIVSNASCTTNCIIPVIKLLDDEFEIESGTVTTIHASMNDQPVIDAYHKDLRRTRAASQSIIPVDTKLAAGITRIFPKFCDRFEAISVRVPTINVTAIDLSVTVKSSVTVKKINELMQKSAATSFRGIVDYTELPLVSTDFNHDPHSAIVDGTQTRVSGQHLIKTLVWCDNEWGFANRMLDTTLAMAATGFK

SEQ ID NO: 18379 - protein, 375 aa, Saccharomyces cerevisiae
MLKVNNVFGSNPNRMTKLEDEHYFIDDIVSIKNRQKSKMYVREGKRIGHGSFGTVTQSILSSNSIEWLGPYAIKRVVKSPKVQSLELEILQNIRHPNLVTLEFFFESHCTTKDGGHLYQKNFVMEYIPQTLSSEIHEYFDNGSKMPTKHIKLYTFQILRALLTLHSMSICHGDLKPSNILIIPSSGIAKVCDFGSAQRLDDNTELKTYFCSRFYRAPELLLNSKDYTTQIDIWSLGCIIGEMIKGQPLFKGDSANSQLEEIAKLLGRFPKSSIKNSQELQDSLNDQKFKKFMHWFPSIEFFDVEFLLKVLTYDATERCDARQLMAHEFFDALRNETYFLPRGSSMPVHLPDLFNFSASEKRALGEYYNLIVPSLD

SEQ ID NO: 18380 - protein, 700 aa, Oryza sativa
MCSQGKRYFGGGDIGFLNAVLWSHIGHWPFKESIGEDPRRQRPRRSQVGPVADPCSCRDRLTMQQAYRAHDELPYMGMDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNACDARLRKSGGISIIVGVRFHLPVKIINAHKNKNSRHHPYPPAPPLASSAPSQNSRHHPYPPAPPPASSAPSPSGRRLSTSVQGECHFRRPALLFHPDMGGEGPALSAPPLPSAPPLSHPNLAPPYNGT

SEQ ID NO: 18381 - protein, 614 aa, Nicotiana tabacum
MDGSVAKGTSCIQDSQSSSVIANTDATLGRHLARRLVEIGIQDVFSVPGDFNLTLLDHLIAEPRLKNIGCCNELNAGYAADGYARARGVGACVVTFTVGGLSVLNAIAGAYSENLPVICIVGGPNTNDYGTNRILHHTIGLPDFSQELRCFQTVTCYQAVVNNLDDAHEQIDRAISTALKESKPVYISISCNLPAIPHPTFSRDPIPFSLSPRLSNKRGLEAAVDAAVTFLSKAVKPVMIGGPKLRVAKACDAFVELADSSGYAMAVMLQPKGLVAEQHPHFIGTYWGAVGTSYCAEIVESADAYLFAGPIFNDYSSVGYSLLIKKEKSIIVQPDRVVIGNGPAFGCVLMKDFLSELAKKIKKNETAYENYRRIFVPEGTPLKSEPNEPLRVNVLFQHIQKMLSDETAVIAETGDSWFNCQKLKLPEGCGYVTNNSLSAWYPFYLQTLEEKSSCCRYEFQMQYGSIGWSVGATLGYAQSVPKKRVISCIGDGSFQVTAQDVSTMIRCEQKNIIFLINNGGYTIEVEIHDGPYNVIKNWNYTGLVDAIHNGEGNCWTMKVRTEEELTEAIATATGEKKDCLCFIEVIVHKDDTSKELLEWGSRVCSANGRPPNPQ

SEQ ID NO: 18382 - protein, 150 aa, Escherichia coli
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGEGVFRGLANPLTVTRYHSLVVEPDSLPACFDVTAWSETR

SEQ ID NO: 18383 - protein, 409 aa, Triticum aestivum; identical to SEQ ID NO: 3056

SEQ ID NO: 18384 - protein, 655 aa, Bifidobacterium longum NCC2705
MALPTPLQAFSGVPKINTAPDKQTIVDGEKMTGAQALIRSLEDLGVEDVFGIPGGAILPVYHEIKDNTKFRFVLMRHEQAAGHAAEGYALATGKVGVCIVTSGPGATNVVTAIADANMDSVPMVVITGQVGVQAIGTDAFQEADIVGITYPVSKHSFLVTRAQDIPRVLSEAYYIANTGRPGPVVVDLTKTAQTGDMYYSWPQRMILPGYNPTTKAHGRVLSDAAKLFSQSYRPVLYVGGGAARSNAGAQVKALADLTGAPVVTTLPARGIIPDSDPKNLGMLGMHGTIAATGAVQRADLLVAIGARFDDRVTGKLDAFAPTARVIHIDIDPAEIGKNRQPDVPIVGDVATVLDDLIPEIQRTQAIQGKPNLAPWWKAIDGWREEYPMTWDEPTDGSLAPQWVIKKLSEMADPSTIWVTGVGQHQMWASQFIDFENQHAWISSGGLGTMGYGLPAAIGASVGSAREFEGKKPVWLIDGDGSFQMTSEELAAAFLDHAPVKIAILNNSVYGMVRQWQTLFYEHHYSQTNLLDGEAHGADGAAALADGDAPLEVPDFIKLAEAYGCVGIRAFTEEEAIAAIEKANQINDRPVLIDFRVWKDAMVWPMVAAGAPNDEVTYKPGIKPLAGGTPAPGTGPDEHATGVFEHETAAATASEH

SEQ ID NO: 18385 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 18386 - protein, 186 aa, Zea mays
  unsure (1)..(186): unsure at all Xaa locations
MAPTVMMASSATAVAPFQGLKSTASLPVARRSSRSLGNVSNGGRIRCMQVWPAYGNKKFETLSYLPPLSTDDXLLKQVDYLLRNGWXIPCLEFSKVGFVYRENSTSPVLXDGRYWTMWKLPMFGXCTTPTQVYKELQEAIKSYPDAFHRVIGFDNIKQTQCVSFIAYKPPGQRLDRAAPAAPPPAS

SEQ ID NO: 18387 - protein, 219 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGPISWSGWRSSERVTGPRPSPPSGAPRKVD

SEQ ID NO: 18388 - protein, 477 aa, Cryptopleura violacea
KNERYESGVIPYAKMGYWDPNYVIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIKGFYDTLLLPYLEVNLPQGIFFKQDWASLRKVTPVASGGIHCGQMHQLLDYLGNDVVLQFGGGTIGHPDGIQAGATANRVALESMVIARNEGIDYVAEGPQILRDAAKTCGPLQTALDLWKDITFNYTSTDTADFVETPTANV

SEQ ID NO: 18389 - protein, 469 aa, Gracilariopsis longissima
VIPYAKMGYWDPDYVIKDTDVLALFRVTPQPGVDPVEASAAVAGESSTATWTVVWTDLLTACDLYRAKAYKVEAVPNTTDQYFAFISYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRATAASGEIKGHYMNVTAATMEDMYERAEFAKHLGSIIIMIDLVIGYTAIQSMAIWARKNDMILHLHRAGNSTYSRQKSHGMNFRVICKWMRMAGVDHIHAGTVVGKLEGDPLMIKGFYNTLLQTNLEINLPQGIFFEQDWASLRKVTPVASGGIHCGQMHQLLDYLGNDVVLQFGGGTIGHPDGIQAGATANRVALEAMVMARNESRDYVAEGPEILRDAAKTCGPLQTALDLWKDITFNYTSTDTADFVETPTANV

SEQ ID NO: 18390 - protein, 455 aa, Porphyra nereocystis
  unsure (1)..(455): unsure at all Xaa locations
VIKETDXXALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDXYERAEFSTDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 18391 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 18392 - protein, 553 aa, Methanothermobacter thermautotrophicus str. Delta H
MADFRCTVCNYIFHEEADGEFDSLPADWRCPVCNAPRTAFVRVPSTLEEGGRTVSEVFISQLAAWGLKYVFGIPGTSTLGLVDALRRNDEIRYIQVRHEAAAAFMASSYGKLTGQPAVCMAVAGPRASNLITGLLDAALDRAPVLAVTGHVETYRIGTGASQEIDQHSLFESFSVYNMTLVSPDEAAEIAREAVKHAILERGVSHVDVPRDVQTMECTAPVKPLRGMMAEAAVTPPRNRLRAAADLINRAERPVIIAGFGALEAADSVVELAERIGAAIVSTFRGKGIVDNDYPLYLGCHGSLGSAAAAEAVRKADLLLVIGSSFSDLTRIPPRRTLQVDIDPMMVARRHPVEQGLTGRSSLIVQELISMVEEKERGPYLAELGELRDEWLGLLESEADPSLRPIRPQYIISVLNRELDDDAIITLDVGENGWWFGRNFQMKSTRGFSFQVTWGSMGFGLPAAIAAQLEFPDRQVVCINNRNLAMIMQEQRVEGFPVWQTELQDCDFAGFAENCGGRGLRVDDPGELEDSVREALGTDGPVLVDIETDPRRFI

SEQ ID NO: 18393 - protein, 117 aa, Zea mays
  unsure (1)..(117): unsure at all Xaa locations
EFGTRAVQRVAKAINFKTCNALLLKVNQIGSVTESIEAVRMSKRAGWGVMASHRSGETEDTFIADLSVGLSTGQIKTGAPCRSERLAKYNQLLRIEEELGDAAVYAGAKXRAPVEPY

SEQ ID NO: 18394 - protein, 543 aa, Zea mays
MAPPTEDCGWLLYLSLAAKCGDPQRLLGFAAVFVAACVVTSLLHWASPGGPAWGWYWWTRRAGLGIVRAAIPGPRGLPVVGSMGLMTGLAHRKLSAAAERQASRRRLMAFSLGETRVVVTADPDVARELLASAAFADRPVKESAYGLLFHRAIGFAPHGAYWRALRRVASAHLFSPRQIAASAAQRAAIARQMVDATTTAAAHAPVVVARRFLKRASLHNVMWSVFGRRYDLMADSREAEELKALVDEGYDLLGQLNWSDHLPWLARFDLQKTRARCCALVPRVNRFVGNIIGEHRARLGRGGDTAVMDFTDVLLSLQGDDKLSDADMIAVLWEMIFRGTDTVAVLIEWVLARLVLHQDVQSKVQEELDRVVGLGQAVTESDTASLPYLQAVIKEVLRLHPPGPLLSWARLATSDVYVSGYLVPAGTTAMVNMWAITHDPSLWPEPMEFRPERFMGPAAEDVPIMGSDLRLAPFGSGRRSCPGKSLAVATVGFWVATLLYEFKWLPPSDEPRGGGVDLSEVLRLSCEMAAPLEARVVPRHAVC

SEQ ID NO: 18395 - protein, 357 aa, Glycyrrhiza echinata
MASSINGRKPSEIFQGQALLYRHIYAFIDSMCLKWIVELDIPNIIHNHGKPITVSELVSILKVPQTKAGNVQRIMRYMAHNGFFERVRIQEEQEENEAYALTAASELLVKGSELCLAPMVECVLDPTLSGSYHQLKKWIYEEDLTLFGVSLGSHFWEFLNENPEYNKSFNDAMASDSQMINLALRDCNSGFEGVESIVDVGGGIGTTAKIICDTFPNLKCIVFDRPKVVENLSGTNNLSYVGGDMFQSVPKADAVLLKWILHNWTDNDCRRILEKCKEAVSSDGEKGKVIIIEMVINENQDEHEITGTKLLMDVNMACLNGKERSEEEWKKLFIEAGFRDYKISPLTGFLSLIEVYP

SEQ ID NO: 18396 - protein, 259 aa, Zea mays
MLAIFWLTRNKVLFQIVIKKKKKKKKKKKKKKKKNSFTASLASRPRPRRPTPPFRPRVSVAAPLSVRVTGGRQGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 18397 - protein, 371 aa, Triticum aestivum
  unsure (1)..(371): unsure at all Xaa locations
MAMLEGMPVDMVNQVKDYYLIRQTLFDIDTQYVPNKPQGLGAYGILCSSINRETDEKVAIKKIHNVFDNGVCELRTLRELKLLRHLRHENVMXLKDIMMPVQRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSTDVWSVGCIFAELLGRKPIFPGTESLNQLELIVNVLGTMSESDLEFIXDNPKARRYIKTLPYTPGVPLASMYPHAHPLAXIDLLQKMLIFDPTKRISVTQALEHPYMSPLYDPSANPPAQVPIDLDIDENISSEMIREMMWQEMLHYHPEAATAVNM

SEQ ID NO: 18398 - protein, 322 aa, Streptococcus pneumoniae R6
MSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEKIQAQVKEAVEASVKFAEESPFPPLESAFEDIYTD

SEQ ID NO: 18399 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 18400 - protein, 487 aa, Candida albicans
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKIYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLNNEEAGALAGSNPDYAQEDLFKNIAAGNYPSWTAYIQTMTEAEAKEAEFSVFDLTKVWPHRKYPMRRFGKFTLNENPENYFAEVEQAAFSPAHTVPYMEPSADPVLQSRLFSYADTHRPHRLGTNYTQIPVNCPVTGAVFNPHSRDGAMTVNGNLGSHPNYLASDKPVEFKQFSSFQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 18401 - protein, 305 aa, Burkholderia fungorum
MMLYFFKRMSEEVMPVVDAAWEEWLSSNVARGCSPDSMIDAMVQAGFATDAARVAVHKTFGQNPANPAFAAAAATEAALAKAAPQTYQYDDPPVARGNLIRAYDRDVRVVMRCERPQVIVFADVLSPDECAEMIERSRHRLKRSTTVNPATGKEDVIRNRTSEGIWYQRGEDPFIERMDRRISSLMNWPVENGEGLQILHYGTTGEYRPHFDYFPPDQPGSAVHTAQGGQRVATLVIYLNDVPDGGETIFPEAGMSVAASQGGAVYFRYMNDRRQLDPLTLHGGAPVLAGDKWIMTKWMRERAYG

SEQ ID NO: 18402 - protein, 524 aa, Uncinula necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVFDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 18403 - protein, 373 aa, Pichia stipitis
MSTVTKTITVLPGDHVGTEICNEAIKVLEAIEQATPYQKIHFEFKHHLIGGAAIDSTGVPLPDDSLAAAKLSDAVLLGAVGGPKWGTGAVRPEQGLLKIRKELNLYANLRPCNFASDALLELSPLKSEIVKGTNFTVVRELVGGIYFGERQEQEESADGESAWDTEKYSVAEVTRITRMAAFMALQHNPPLPIWSLDKANVLASSRLWRKTVDKVMKEEFPQLTIQHQLIDSAAMILVQSPTKLNGIVITSNMFGYIISDEASVIPGSLGLLPSASLASLPDTNSAFGLYEPCHGSAPDLPENKVNPIATILSVAMMLRLSLDSLKEAEALEEAVRQVLDSGVRTADLRGTNSTKEVGEAVVAGVTKILKDAA

SEQ ID NO: 18404 - protein, 986 aa, Thermobispora bispora
MPLPRPLRAMPLRRPLRRAPRVTLVLALTAAPARADADLPFRDPTLPLAQRIDDLLGRLTLDEKISLLHQYQPPIERLGIKSFKTGTEALHGVAWSTDVTDNGAVVTANGTVFPQAVGLASTWDPELNQRVGTVGEEARGFHAQNPVVWGLNLWAPVVNLLRDPRWGRNEEGYSEDPLLTGAIAIAYGSGIQGDDPDHLRAAPTLKHYLANNNEIRRDTTSSNLPPRVKHEYYEAPFRAAITAGAATGVMTAYNLVNGRPATVNPDLNDTVRTWTDRDLLNVTDAGAPNNLVGSQAYFATLAEADAAALKAGIDSFTTDETNSAPTITAIKTALSQGLLTEQDIDTAVRHILGIRFRLGEFDPDGGPYAKITPDVIDSPAHRRLARETAAKAMVLLKNERGTLPLDPGKKVAVVGPLADVLYTDWYSGRPTYQVTPLDGIRERAASVTSSEGVDRVAFKDLATGQVHHRGERPEGADLRLSATTIGETEQFDVFDWGQGIVTLRSVANGKYVSRANWSTLVNNADQPSGWFVQEQFKLEEQDDGSYLIRYAGYETAYDWFGPNTYVKAAPDGTLTLTTAGDATRFAKEVVRSGIDDAVAKAKEADVAVVVVGSMPFINGREDHDRTDMNLAEGQEALVKAVFNANPRTVVVLENSYPTTINWIDEHVPAILWTTHAGAETGNALADVLYGDVNPAGRLTQTWYLGGRLPDILDYDIVQRDRTYLYFKGTPLYPFGHGLSYTTFRYQGLRVAEKGDAYEVSVRVTNTGHRAGDEVVQVYTHQRTSRVKQPVKQLRAFQRITLAPGQSKTVTFTIRKADLALWDVTRNKWTVETSAHDVMVGASSADIRQRATIHVKGERIPDRDLSVPTRAIDFDGYSGVELVDETKARGDAVAGSTGDWIVFKDVDLKRRPSRVTAGVASTSGGSIELRLGSPKGKLIATVPVAATGDVYRYETAAARVTGPSGVKDLYLVFQGDVRIKDLSLTSG

SEQ ID NO: 18405 - protein, 525 aa, Triticum aestivum
  unsure (1)..(525): unsure at all Xaa locations
LSPPSLITPSPARPLRSLHSPNLPGQGGAAATCAACPAALRGAAGATATNSPCYRCTGSTAAVASTDPTFSAFPAFRVSARLLPFSTPCAASARXTMNIMIINVLKRARRRRPSALLXLFRFPFAFRSNGFVGKDFFGLRDMAQPGFDYGFFFFXLWAVVRAPDGMTYGVLLSVKXHLICDLIIGRCFPGTVXPMLCRSCVRWQDCKIGTQVRGASLLXSVIDYTRSGVVHIVGMVTCWWGVFTLGTRIDRFDHACRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAGRPYGLFLGGGGRLLAAHIVQILVIAGFVSCTMGPLFLALKKLGLLRISAEDEMAGMDLTRHGGFAYVYHDDDEHDKSVGGFMLRSAQTRVEPAAAANSQV

SEQ ID NO: 18406 - protein, 333 aa, Xanthomonas axonopodis pv. citri str. 306
MAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 18407 - protein, 332 aa, Euglena sp. CRRdV
NGFGRIGSLVLGALVEKRVLGQELSCVAVVDVSTDADYFAYQLKYDSVHGLFRGEIGTDLSSSQLKEKDILIVNGNRIRCLPAQKELSLLPWKEMDVDLVIESTGLFTDADLARDHLAAGAKKVLITAPGKGVDLKTIVMGVNEGEYHPLKHSILSSASCTTNCLAPLVHVLMREGIGIETGLMTTIHAYTATQKTVDGPSKKDWRGGRAAAVNIIPSSTGAARAVGECIPAVKGKLTGMAFRVPTPDVSCVDLTFRSVRETSITEIDQCLRTASETYLKGILGVTEDPVVSSDFIHDSRSSIYDASATLENNLKGEKRFFKLVAWYDNECG

SEQ ID NO: 18408 - protein, 459 aa, Porphyra rosengurtii
DADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPIAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 18409 - protein, 220 aa, Zea mays
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAVVVVPKQAAGSKNEWVLCRVFKKSLAVGGAAAAPAAGKRGGTETSSNSKTGDVAAIAHLPPLMDVSGSGA

SEQ ID NO: 18410 - protein, 179 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKFVNPLLLHPDLVKVPQRRTVAFPDRVLVLSLSLFRYCVCFDPLDGSSNIDCGVSIGTIFGIYMV

SEQ ID NO: 18411 - protein, 204 aa, Zea mays
  unsure (1)..(204): unsure at all Xaa locations
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAXVVVPKAAGSKNEWVLCRVFKKSLARRWCSCSSSTNRRQEGRHGDVVQPPDGRR

SEQ ID NO: 18412 - protein, 314 aa, Caulobacter crescentus CB15
MTLPPTRRVIGPVARAGERTGRPRVSFEFFPPKTPQMEESLWQAITRLAPLDPAFVSVTYGAGGSTRERTHRTVKRILDETSLKPAAHLTCVGASREEVDEVIREYWETGVRHIVSLRGDPPPGEGGIGGVYVPRADGYANATELTKAVRAIAPFEVLVGVYPEKHPESPSLEHDIDVLKQKVDAGATLGISQFFFDLDAFLRFVDKVRAAGITIPIVPGIMPVTNFAGLKKMAAACQTAIPSWLGNLFDGLENDAETRRLIACSVAAEMCAKLQEQGFEDFHFYTLNRADLVYAICRVLGVREISPAASEVAA

SEQ ID NO: 18413 - protein, 405 aa, Agrobacterium tumefaciens str. C58
MNPLLPVDEAIKRLLEAAVPVTDSETLPLAECDGRVLATDLAARLTQPPFDASAMDGYALRSADAAEIGSVLTLIGQAAAGHAFAGTVGKGEAVRIFTGAPVPDGADTILIQEDAELLDDGKIRTTFAVTAGRHIRPRGQDFTEGETALEAGRELGFTDLTLAAAMNHAALSVYRRPRIAILATGDELLPPGSAPEPAQIIASNTFGVAALARQAGAEVIDLGIIADDDSLIRAAIRRAVAAGVDVLVTLGGASVGDHDLVQAALKAEGMQLDFWRIAMRPGKPLMVGAIGSTQVLGLPGNPVASLVCGLLFLEPLIRRIARRAPLQRSTSARTATPLKANDQRQDYLRARFSADENGALVAEAYAKQDSSMMKILAHSDGLIVRPPHAPEAAPGAICPVIRLKP

SEQ ID NO: 18414 - protein, 573 aa, Nostoc sp. PCC 7120
MAAEHGLILDFTTVLGASALGGYLANRLRQPVLLGYLVTGLALGPYGLKLLSDVPRIQSLASIGVAFLLFALGVEFSLTELRRVKNIAINGSLLQIGLTTALVAFLTITLGWVDNLTQGIFLGVVLSLSSTAVVLKTLGERGETNTLHGQVMLAILIAQDLALGLILAFLPVLNQPERLVWALGIALLKVLLFLALAIALGRWIVPKLISNVAATESTELFVLTVISLCLSVALVTAKLGLSIEMGAFVAGLMVSEIDHADHALAKVLPLRDTFACLFFASIGMLIDPIALMQNLGLVLGLVTLVMLGKAIVVMPIILKFGYSLKTTILTSLGINQIGEFSFVLALAGLQLQLIPEKTYILLLETTAITLVLTPISLNIAPQLIERLTQIPFFAQSLRQFTEPNILSIPETISGHVVVAGYGRVGQVIVNILLNQGYVVLVIENSEAAIQRLRMQRIPYIFGDADSELVLEKIHLETAKALAIALPDPASSRLLLKRALAIAPKLDVIARSHHDNEIDLLTQMGAKEVVQPEFEAALELSAHLLSTLGEAKSQIDTVISDIRTDRYRSIRPRR

SEQ ID NO: 18415 - protein, 524 aa, Uncinula necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 18416 - protein, 341 aa, Trifolium repens
QTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGIPVETLVKLVPEHARKQCPFLGL

SEQ ID NO: 18417 - protein, 124 aa, Salmonella enterica
MSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKN

SEQ ID NO: 18418 - protein, 443 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKA

SEQ ID NO: 18419 - protein, 411 aa, Medicago sativa
MASGGVAPASGFIDKNASSVGVEKLPEEMNDMKIRDDKEMEAATIVDGNGTETGHIIVTTIGGKNGQPKQTISYMAERVVGHGSFGVVFQAKCLETGETVAIKKVLQDKRYKNRELQTMRLLDHPNVVSLKHCFFSTTEKDELYLNLVLEYVPETVSRVIRHYNKMNQRMPMIYVKLYSYQICRALAYIHNSIGVCHRDIKPQNLLVNPHTHQLKICDFGSAKVLVKGEPNISYICSRYYRAPELIFGATEYTTAIDIWSAGCVLGELLLGQPLFPGESGVDQLVEIIKVLGTPTREEIKCMNPNYTEFKFPQIKAHPWHKIFHKRMPPEAVDLVSRLLQYSPNLRSTALEALVHPFYDDVRDPNTRLPNGRFLPPLFNFKVNELKGVPAEMLVKLVPPHARKQCALFGSS

SEQ ID NO: 18420 - protein, 365 aa, Bacillus subtilis subsp. subtilis str. 168
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAAARKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 18421 - protein, 220 aa, Enterobacter cloacae
YDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEG

SEQ ID NO: 18422 - protein, 669 aa, Schizosaccharomyces pombe
MTVLVPLRRLDTRAAFSSYGREIALQKRFLNLNSCSAVRRYGTGFSNNLRIKKLKNAFGVVRANSTKSTSTVTTASPIKYDSSFVGKTGGEIFHDMMLKHNVKHVFGYPGGAILPVFDAIYRSPHFEFILPRHEQAAGHAAQAYSRVTKKPGVVLVTSGPGATNVITPIADALADGTPLVVFSGQVATSAIGSDAFQEADMVGISRSCTKWNVMVKDVADLPRRIDEAFEIATSGRPGPVLVDLPKDVTASVLKEPIPILSSVPSMNRRMKEVLEEGSKNVTAKIDRVGNLLKLAKKPVIFCGHGVLANPECPTLLRKFSERLQIPVTTSLLGLGAVDERSDLSLHMLGMHGSGYANMAMQEADLILALGVRFDDRVTGNVSLFAPQARLAAAEERGGIIHFDISPKNIGKVVQPTEAIEGDVYESLKLLDSATKNIKIPSRFDWLSQIQTWKERFPFTFTRSAPGELVKPQEVIQELDKQTSDIKDKVTITTGVGAHQMWAATFYRWTKPSSLVTSGGLGTMGFGLPAAIGASVAAPKDIVIDIDGDASFSMTGMELATVRQFDIPVKILILNNEEQGMVTQWQNLFYEKRYSHTHQKNPNFVKLADAMGIKALRVEKREDLAKKMKEFLSTKGPVLMEVLVAQKEHVYPFVPGGKALHQFILHESLS

SEQ ID NO: 18423 - protein, 263 aa, Haemophilus influenzae Rd
MARRPLVMGNWKLNGSKAFTKELIEGLKAELHDVTGCDVAIAPPVMYLGTAEAALSGCGCSCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 18424 - protein, 511 aa, GIBBERELLA ZEAE PH-1
MSLNTPAAGQSAPVNNPEAISSGRQDLLYNYSTGNVDVPRGFKYRQYRIFGYTLPWYASPRIQLGMVAFLAFIADRLQNTALYSTFAVVGFFGGTFVNKLGVKLTLALGGIGYGIYTISILLYNHFGNDIRGFNIFAGVLLGFCAAMLWTAQGTIMISYPHEHQKGHYFAWFWGIFNLGAVIGSLIPLGSNINSQGNVNVNDGTYIGFIVLMFFGATLALLLCNANDVVRKDGSYVILMKNPTWQSELLGLYETIRFEPFVIFLFPMFFSSNWFYVYQQNAVNGAYFATKAKALNSLLYWLAQIAAAAIWGYLLDLEYLRRSVRAKIALVVLFALTFIVWGGGYVHERTYTRATTEEMGKDGGKEWDDAGYAGPLVLYIFYGFYDAAWQATVYWFMGALSNSGRRCANYIGFYKGIQSAGAAISNNLDARKVSFEAQFISNWILLASSLVIAAPVIFLKIRDHVAMAEDLEGTDETLADVAPTYVLTHPRHNVETHDSKESKQNGPGFTAV

SEQ ID NO: 18425 - protein, 307 aa, Glycine max
HLLLQVDILLCTDCFHDGRFVIGHSSIDFVRVDSTRDYGELDGDSWTDQETLLLLEAMEIYNENWNEIAEHVGTKSKAQCILHFLRLPMEDGKLENINVPSMSLSSNAINRDHSGRLHCYSNGDTAGTVHQTRDSDNRLPFANSGNPVMALVAFLASAVGPRVAASCAHAALAVLSEDNSGSTSQMEAPGHDNRTNSENIHCRDGGPHGETAVSNNHNEDKAKVRGSWGLNEGRITPLSAEKVKDAAKAGLSAAAMKAKLFADHEEREIQRLCANIVNHQLKRLELKLKQFAEIETLLMKECEQLER

SEQ ID NO: 18426 - protein, 470 aa, Solanum tuberosum
NKIKPGVAYSVITTENDTQTVFVDMPRLERRRANPKDVAAVILGGGEGTKLFPLTSRTATPAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 18427 - protein, 450 aa, Triticum aestivum
  unsure (1)..(450): unsure at all Xaa locations
MGALPRGLLVLGVCAVLVAAVLADASPASSMVVGLAKCADCTRKNMKAEAAFAGLQVAVKCKNAHGEYETKAIGTVDKSGAFGVPLGADLLREDGELKQDCFAQLHSAPDHPCPGQEPSMIVRQSADGAEKKSFVAVPGEVHYSSQECASAFLCHFFHKKHLFHKKSALVVPHLKKKAIVIPHIHKKPIVIPHFHKKPAPVPVPEYKPPTPTPVYTHPKPVPEIQAXPTPVYPHPAPIYHPPAADQKAALNPETDPQLFKKLLHKKPIVIPHLPIVIPHFHKKPAPVPVPEYKPPTPTPVYTAPDAGARVQATDSGVPAPVADLPPSCRRSEGSRRANYPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 18428 - protein, 151 aa, Escherichia coli
GVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMG

SEQ ID NO: 18429 - protein, 281 aa, Pseudomonas syringae pv. tomato str. DC3000
MSQERRFSFEFFPTKTDAGHEKLLTVARQLATYNPDFFSCTYGAGGSTRDRTLNTVLQLENEVKVPAAPHLSCVGDSKEDLRSLLAQYKDAGIRRIVALRGDLPSGMGMASGELRHANDLVAFIREETGSHFHIEVAAYPEMHPQARNFEDDLKHFVTKANAGADSAITQYFFNADSYFNFVERVEKMGVSIPIVPGIMPITNYSKLARFSDACGAEIPRWIRKQLEAYGDDVQSIQAFGEDVITQMCERLLEGGAPGLHFYTLNQAEPSLAVWNNLQLPR

SEQ ID NO: 18430 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 18431 - protein, 769 aa, Panax ginseng
MWKLKVAQGNDPYLYSTNNFVGRQYWEFQPDAGTPEEREEVEKARKDYVNNKKLHGIHPCSDMLMRRQLIKESGIDLLSIPPLRLDENEQVNYDAVTTAVKKALRLNRAIQAHDGHWPAENAGSLLYTPPLIIALYISGTIDTILTKQHKKELIRFVYNHQNEDGGWGSYIEGHSTMIGSVLSYVMLRLLGEGLAESDDGNGAVERGRKWILDHGGAAGIPSWGKTYLAVLGVYEWEGCNPLPPEFWLFPSSFPFHPAKMWIYCRCTYMPMSYLYGKRYHGPITDLVLSLRQEIYNIPYEQIKWNQQRHICCKEDLYYPHTLVQDLVWDGLHYFSEPFLKRWPFNKLRKRGLKRVVELMRYGATETRFITTGNGEKALQIMSWWAEDPNGDEFKHHLARIPDFLWIAEDGMTVQSFGSQLWDCILATQAIIATNMVEEYGDSLKKVHFFIKESQIKENPRGDFLKMCRQFTKGAWTFSDQDHGCVVSDCTAEALKCLLLLSQMPQDIVGEKPEVERLYEAVNVLLYLQSRVSGGFAVWEPPVPKPYLEMLNPSEIFADIVVEREHIECTASVIKGLMAFKCLHPGHRQKEIEDSVAKAIRYLERNQMPDGSWYGFWGICFLYGTFFTLSGFASAGRTYDNSEAVRKGVKFFLSTQNEEGGWGESLESCPSEKFTPLKGNRTNLVQTSWAMLGLMFGGQAERDPTPLHRAAKLLINAQMDNGDFPQQEITGVYCKNSMLHYAEYRNIFPLWALGEYRKRVWLPKHQQLKI

SEQ ID NO: 18432 - protein, 487 aa, Brucella suis 1330
MKAQPKASHFIGGAFVEDKAGKPLPVIYPATDEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 18433 - protein, 195 aa, Streptomyces sp.
YPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 18434 - protein, 164 aa, Prochlorococcus marinus subsp. pastoris str. CCMP1378
MNQFFSRRSFILIPIMSILKFILQPKKVLAAFAASDDDWNLSKEDWKNKLSPESYYILREEGTERAFSSQLNNEKRKGIFYCAGCNQPLFTSDTKFDSGTGWPSFWDPIQGSVETKVDFKLIVPRTEYHCSRCGGHQGHVFNDGPLPTGKRYCNNGLALKFIAE

SEQ ID NO: 18435 - protein, 371 aa, Zea mays
MRRHMAPIKEQKHTTSAEQQVMLDAELQLWNHTFGYVKSMALKAAIDLGIPEAIHQHGGTATLPQIVTRVKLHPSKTPCLRRLMRVLTLTGVFGAQEAHDDDGGCDDELVYTLTPASRLLVGSPGQNVGPFLTLMLGPIFVSSFLDLRGWFQHETPDPSPFKMTHGRDIWELAAHDAAFGRLFDAGMVADSSFIMDVVVRECGGVFEGISSLVDVAGGLGGATQTIAKAFPNLECSVLDLPNVVASAPTDTAVKYVAGDMFESVPSADAVFLKWIMHDWGDADCVKILKNCKKAIPAQGGKVIILDIVVGAGSSCDRKNVETQCLFDLYIMTINGVQRDEREWKKIIFEAGFTSYKIIPVLGTRSIIEVCP

SEQ ID NO: 18436 - protein, 531 aa, Yarrowia lipolytica
MLQLFGVLVLALTTALLAQLAYNKYEYNRKVKQFGCGELTVAKNGFLGWKGIRAVLHVLKTKKGPAALKERIDAYGRTYVFHIGPAPVISTMEPENIKAMLATQFKDFSLGTRYRSLAPTLGDGIFTLDGHGWTHSRALLRPQFAREQVSRLDSLEAHFQILKMCVDKEMREKGNDPRGFDIQNLFFLFTLDSATEFLFGSSVDSLVDFLDDPSVRTGDHGGVDEAARKGFNNSFNHAQELCALRSRLHTLYWIVGSVVKKEPFERYNKEIKTFVDFFAAKALKARKEKDMSLMDNDQYIFMYELVKETTNPVTLRDQMLNILLAGRDTTASMLSWIYFRLARDPKLYAKLRSAILEDFGTTPEAITFESLKQCDYLRYVLNEALRLYPVVPINGRTATRDTTLPRGGGPDQSQPIFIPKGQTVSYSVYWTHRDPRFWGEDAEEFIPERWDPRNGNIGRGWEYLPFNGGPRICLGQQFALTEVGYVLSRLVQTYETLETCDHKPLPPLYNHALTMCHEEGVWVKMYKGEKA

SEQ ID NO: 18437 - protein, 507 aa, Eremothecium gossypii
MAGNNDKTNSAEVREDRVVTNSVGNPINEPFATQRVGQHGPLLLQDYNLLDLLAHFNRERVPERNPHAHGSGAFGYFEVTDDITDVCGSAMFGEVGKRTRALVRFSTVGGEKGSADTVRDPRGFAVKFYTEEGNLDWVYNNTPVFFIRDPSKFPHFIHTQKRNPRTNLKDANMFWDFLTTPENQVAIHQVMILFSDRGIPASYRHMNGYSGHTYKWSNKQGDWRYVQVHIKTDQGIKNLTAEEGAKLAGEDPDFCQQDLVQALERGEYPSWTVYIQTMTEEQAQKLPFSVFDLTKVWPHKDFPLRRVGRLVLNEVPTNFFAQIEQAAFSPATTVPYQEPSADPVLQARLFSYADAHRYRIGPNYHQVPVNCPYASKFFNPAIRDGPMNVDGNLGSEPNYLATNNNYRFLGADRPIQQHQETWQGPAQPVHWATTGDIDFAQATALYHVLGRTPGQQRNLAHNVAIHVASADPPIQERVFQMFSRVDKGLGEAIRSEATALSQKKPKL

SEQ ID NO: 18438 - protein, 313 aa, Oryza sativa
  unsure (1)..(313): unsure at all Xaa locations
MWRLKVAESGGTPLLRSTNGFLGRAVWEFDPDHGTPEDRADVERVRREFTDHRLHHRESADLLMRMQQASTSSLSYXPVNNKLGEKEEVTEEIAMASLRRALDEFSSLQADDGHWPGDFSGVMFIMPGLIFALYVTGSLDTIISPEHRREICRYIYNHQNEDGGWGSLMLSSSTMFGTCSNYITLRLLGEETSNEQLAKGRIWIILHGGTTFVPQWGKIWLSILGVYEWAGNNPIFPELWLTPQFLPFHPGKFWCLTRMVYLPMAYLYGKKFVGPTAPTILALREEIYSAHYLTIDWAQARSACAKSHFHIPS

SEQ ID NO: 18439 - protein, 336 aa, Glycine max
  unsure (1)..(336): unsure at all Xaa locations
LEANAILAVSVSLAVCNAGAAVKKIPLYKHIAXAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 18440 - protein, 158 aa, Triticum aestivum
  unsure (1)..(158): unsure at all Xaa locations
MAPTVMASSATSVAPFQGLKSTAGLPVSRRSNGASSAAXHNGGRIRCMQVWPIEGIKKFETLSYLPPLSTEALLKQVDYLIRSKWVPCLEFSKVGFIFREHNASPGYYDGRYLTMWKLPMFRXTDAKKVIXNEVEXVKKXYPXAXVRIIRFXKWARMR

SEQ ID NO: 18441 - protein, 504 aa, Streptomyces coelicolor A3(2)
MSRPLEPSATDEEQRLRELGYRPVLARRMGGFGNFAISFSVISILSGCMTLYGFGMGTGGPAVMLWGWAGVGLFVLCVGMALAEVTSAYPTSGALYYMADRLGGRRWGWYTGWLNLLGLLGAIAGIDYGAALFTGAFLNLQWGFEPTPEKTMLIFVVILLLHATLNLFGVRLVSVLNSISVWWHLAGVALIVGALVIVPDHHQSPSFVFTEFVNDTGWENPLYVAAIGLLLAQYTFSGYDASAHLSEETSNASVSAARGIVRAIWVSWLAGFVLLAGLTFAIQDYDATRDTATGVPPAQILLDGLGTDGASALLLVVIVAQLFCGNAEVAAASRMVFAFSRDGALPGSSLWRKVSARTQTPVAAVWLSVAVACLLALPSLYSATAYGAVTAINVIGITPAYAIPVLLRLRAGDRFTPGPWNLGRWSRPVGWVAVVWVALVTVLFCLPQSSPVTADTMNYAVVALVVVLVLATVWWFVARRSYGTPTTAAYGDDREQAELAEGIV

SEQ ID NO: 18442 - protein, 485 aa, Desulfovibrio vulgaris subsp. vulgaris (strain Hildenborough)
MDKKRLTTNAGAPVADNQNVMTAGPRGPQLLQDVWFLEKLAHFDREVIPERRMHAKGSGAFGTFTVTHDITRYTRAAIFSEVGKKTDLFVRFSTVAGERGAADAERDIRGFAVKFYTEQGNWDMVGNNTPVFFLRDPLKFPDLNHAVKRDPRTNLRSARNNWDFWTSLPEALHQVTVVMSDRGIPATYRHMHGFGSHTFSFINAKGERFWCKFHFKTQQGIKNLTDAEAEAIVGKCRESHQRDLYDSIERGDFPRWTMYVQVMTEEKAAALPYHPFDLTKVWYHDDAPLIEVGVLELNRNPENYFAEVEQAAFNPANVVPGIGFSPDKMLQGRLFSYGDAQRYRLGVNHHLIPVNMPRCPFHSYHRDGMMRVDGNHGSTLAYEPNSYGEWQEQPGFAEPPLELSGAAAHWNAREDDADYFTQPGKLFRLMTPAQQEELFGNTARALGDAPDAIKLRHIGNCLKADPAYGNGVAKALGLDPAKALG

SEQ ID NO: 18443 - protein, 338 aa, Arabidopsis thaliana
MADKKIRIGINGFGRIGRLVARVVLQRDDVELVAVNDPFITTEYMTYMFKYDSVHGQWKHHELKVKDDKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 18444 - protein, 315 aa, Lyngbya sp. PCC 7419
NGFGRIGRNFVRCLLTRENSNLDLVAINDTSDPKTNAHLLKYDSMLGTLKDVDIQADENSLTVNGKTIKCVSDRNPLNLPWADWGVDLIIESTGVFVTEEGASKHLEADAKKVLITAPGKGGKIGTFVMGVNDNTYKHEDYNIVSNASCTTNCLAPFTKVLHEHFGIIKGTMTTTHSYTGDQRILDASHRDLRRARAAAINIVPTSTGAAKAVALVIPEMKDKLTGIAMRVPTPNVSVVDLVVQVEKNTFTEEVNRVLQEAAEGPMKGILEYSDLPLVSSDYRGRDASSIVDASLTMVMGGDMVKVIAWYDNEWG

SEQ ID NO: 18445 - protein, 129 aa, Glycine max
IKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 18446 - protein, 765 aa, Escherichia coli CFT073
  unsure (1)..(765): unsure at all Xaa locations
MKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSIMGKTMVQAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMEELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFXIDIEALKFWNQQMKYDAEPGKFNVFIGTDSARVKKAEFELL

SEQ ID NO: 18447 - protein, 492 aa, Oryza sativa (japonica cultivar-group)
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLREPRGFAVKFYTREGNFDLVGNNMPVFFIRDGMKFPDMVHAFKPSPKTNMQENWRIVDFFSHHPESLHMFSFLFDDVGIPLNHRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 18448 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 18449 - protein, 481 aa, Photobacterium profundum
MTKSTLTQANGTPVVDNDNSLTAGPSGPILLQDTWLLEKLAHFDRERIPERVVHAKGSAAFGTFTVTHDISALTKANLFSEVGKETDVLLRFSTVAGEKGAADAERDVRGFALKFYTDEGNWDLVGNNTPVFFIRDPLKFPDFIHTQKRNPITNLRSATAAWDFWSRHPESLHQVTILFSDRGIPTDYRHVNGYGSHTYSFINSNNERSWVKFHFKTQQGHKHYTDEEAVNVVGKSRESSQVDLFMNIEEGNFPRWDVKVQIMTEQQAQEVSFHPFDLTKVWPHGEFPLIDVGVLELNRNPENYFAEVEQAAFSPANIVSGIGFSPDRMLQGRLFSYGDTQRYRLGVNHGQLPVNKPKSPVHTTHRDGSMRGDDNGGKEPNYAPNHYNAYVPTHEQEPALALEKAALHYDFREYDEDYYTQPGNLYRIMDAEQQQRFIQNLIASLSEVDCEQIKRNQIYHFYQADKSLGKALAEGLGVSIG

SEQ ID NO: 18450 - protein, 481 aa, Citrullus lanatus
NSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 18451 - protein, 806 aa, Oryza sativa; identical to SEQ ID NO: 11019

SEQ ID NO: 18452 - protein, 353 aa, Methanosarcina barkeri
MAENIQSKGYAGKDESGKLVPWSFERRPVGDNDILIDIKYCGVCHSDIHQIKGHWGPQQYPQVPGHEIVGVVAAVGKNVTKFKVGDRAGVGCMVSSCMECESCKNGEEHHCDNNATIMTYGYPEESSPTGISQGGYSQNIVVTEHFAIKIPDSIDLQEAAPLLCAGITTYSPLMRANFKKGDKVGVAGIGGLGHVAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIQMIKPEMINEIWEKVVNKEARYRYVIDMSSL

SEQ ID NO: 18453 - protein, 364 aa, Saccharomyces cerevisiae
MSAPKKIVVLPGDHVGQEITAEAIKVLKAISDVRSNVKFDFENHLIGGAAIDATGVPLPDEALEASKKVDAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 18454 - protein, 435 aa, Spyridia filamentosa
  unsure (1)..(435): unsure at all Xaa locations
ETDVLALFRVTPQPGVDPVEASAAVAGESSTATWTVVWTDLLTACDLYRAKAYKVDEVPNSTEQYFAYIAYDIDLFEEGSIANLTASIIGNVFGFKAVKALRLEDMRIPYAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKELGSIIIMIDLVIGYTAIQTMGIWARKHDMILHLHRAGNSTYSRQKNHGMNFRVICKWMRMAGVDHIHAGTVVGKLEGDPKMIQGFYRTLLEPFLEVDLPQGLFFEQDWASLRKVTPVASGGIHCGQMHQLIQYLGNDVVLXFXXXXXXXXXXXQAGAPANRVALESMIIARNEGRDYVNEGPQILRDAAKTCGPLQTALDLWKDITFN

SEQ ID NO: 18455 - protein, 130 aa, Oryza sativa
EPGKQVRSAVKIKNISKSHVAFKFQTTAPKSCFMRPPGGILAPGESIIATVFKFVEHPENNEKPLDQKCKVKFKIVSLKVKGPMEYVPELQMDKLKRQLAEAEAALEARKKPPEDTGPRIVGEGLVIDEW

SEQ ID NO: 18456 - protein, 168 aa, Avena clauda
VMASSATSVAPFQELKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 18457 - protein, 521 aa, Candida maltosa
MIDEILPKLVQYWYIVLPTLLIIKHVVSYINTQRLMRKFRAKPVTNVLNDGFFGIPNGIKAIKEKNKGRAQEYNDEKFAAGPKPKVGTYLFKLFTKDVLVTKDPENIKAILATQFEDFSLGKRLDFFKPLLGYGIFTLDGEGWKHSRAMLRPQFAREQVGHVKLIEPHFQSLKKHIIKNKGQFFDIQELFFRFTVDSATEFLFGESVESLKDESIGYDQQDFDFDGRKNFAEAFNKAQEYLGTRAILQLFYWLVNGADFKKSVAEVHKFTDYYVQKALDATPEELEKHSGYIFLYELVQQTRDPKVLRDQSLNILLAGRDTTAGLLSFALFELARNPEVWSRLREEIGDKFGLDEDATIEGISFESLKQCEYLKAVVNECLRMYPSVPRNFRIATKHTTLPRGGGPDGKDPIFIKKGAVVSYGINSTHLDPMYYGPDARLFNPDRWSKPETKKLGWAFLPFNGGPRICLGQQFALTEASYVLVRMIQNFKELELTPNTVYPPRRLTNLTMSLYDGAYIKVN

SEQ ID NO: 18458 - protein, 562 aa, Sinorhizobium meliloti
MPPPLPERRHLICACVGTYCGCGSNPPSGSSPFVPASFFVPAEGTAEPRCGGVSSPRSRAGFSPRIRALISSPVSVSYSSKPSARATNSLTAGPRGGIMLQDYQLIEKLAHQNRERIPERVVHAKGWGAFGSLKITGDISQYTRAKCLQPGAETPMLARFSTVAGEQGAADHERDVRGFALKFYTDEGNWDLVGNNTPVFFIRDPYKFPDFIHTQKRHPKTNLRSATAMWDYWSLSPESLHQVTILMSDRGLPQTPMHMNGYGSHTYSFWNDAGERYWVKFHFKTQQGHKFFTNEEGEAVIGKTREGYQESLFYAIENGEFPRWTVQVQIMPELDVEKTPYNPFDLTKVWPHADYPPVEIGVLELNRNPENYFAEIENAAFSPSNIVPGIGFSPDKVLQARIFSYADAHRYRLGTHYEHIPVNQPRCPVHHYHRDGQMNTYGGIRTGNPDAYYEPNSFNGPAEQPLAKEPPLRIDGDMSRYDHRVGNDDYVQVRALFGLFDEGQKSRLFSNIAAAMGGVPGEIIERQLIHFARVHPEYEAGVRQALKTAHGYEADTISTAAE

SEQ ID NO: 18459 - protein, 490 aa, Zea mays; identical to SEQ ID NO: 14476

SEQ ID NO: 18460 - protein, 492 aa, Neurospora crassa
MTGKGKSRWADSAEDAALEAQLKKEKEEKKRLKAEKARKAEAEKKKREAEAAAAAQRQQQQQQQTGDDDDANGPPAKRRRLSPDRDAAAAAPTASSNDSSKLLRFEGGRFGKCRSVENYDKLNDIEEGAYGWVARAREIETGKVVALKRLKIDPKDRSGLPVTGLREIQILKDCSHRNIVKLKEVVVGDDTSKIENIFIVLEFLEHDLKSILEDMPEPFLASEVKTLLLQLCSGIAYLHSHYILHRDLKTSNLLLNNRGQLKIADFGMARYVPDPPPPKLTQLVVTLWYRAPELLLGAARYGPEIDMWSVGCIFGELLTREPLLQGKNEVDELTKIFELCGLPTDESWPGFRRLPNARSLRLPSSSSSSSSSSKPPSTGGLIRAKFPLLTAAGVSLLASLLSLNPSRRPTASEMLEHEYFRQDPKPKQEAMFPTFPSKAGQEKRRRRETPNAPQRGQKVQDLGQVDFSSLGGIFGSGREREERGGGFSLRMV

SEQ ID NO: 18461 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 18462 - protein, 650 aa, Listeria monocytogenes EGD-e
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVMQKLQDLDSNEYNPEIISLYLMNFERALGRGKNKKESNDEALQTTIDLASQIERETIQRYFEKGTITRKEMKVYRDNLLAIEANMQLEF

SEQ ID NO: 18463 - protein, 322 aa, Arabidopsis thaliana
MDSDFVPPSVSFQLPVIDFSDQNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRIAQSALHAFAAF

SEQ ID NO: 18464 - protein, 500 aa, Agaricus bisporus
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 18465 - protein, 257 aa, Desulfitobacterium hafniense
MGAIGVVFGDIGTSPLYTLKEAFSPHFHLTSNHDTVLGILSLVFWALMIVVTVKYVTIIMRADNDGEGGIMALMTLAQRTLAKGGRSAYVVGILGIFGASLFFGDSVITPAISVLGAVEGLEVAAPGLHRFIVPITVLILVMVFLAQRFGTEKVGKVFGPITMIWFVSLAAIGVYNILQGPEVLKALNPMWGARFFMEHGAQSVLILGVVVLAVTGGEALYPTWAIRRQAIRWAGHLVCEPGLLPARPFVTPAGVTL

SEQ ID NO: 18466 - protein, 508 aa, Oryza sativa
MSRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIMGQLLQVIILLATGGANGGGYMASKYVVLAIYSAILILHGLINSLPIRWLSWFGQLGAFWNVAGAFSLTILIPAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 18467 - protein, 389 aa, Methanosarcina acetivorans C2A
MTFPMYSDRINALPPYLFAAIDEAKDEMIAKGVDVIDLGVGDPDLPTHPHIVEAMREAVCDPKTHQYPSYAGMPEFREAAAEWCKKYKGIELDPATEVLSLIGSKEAVAHIPLAFVNPGDVVLYTDPGYPVYKIGTLFAGGEPYSLPLKAENSFLPDLDSIPADILKRAKLFFFNYPNNPTSATADMKFFEKVVEFCKKNDIIAVHDNAYSQMVYDGYDAPSFLAAEGAMDIGIELYSHSKTYNMTGWRLGFAVGSKALIKGLGKVKSNVDSGVFDAIQIAGIAALSSSQACVDDTNKIYEERRNVLIEGLTAMGLEVKPPKATFYVWAPVPTGFTSIEFAKLLLEEAGIVATPGVGFGDAGEGYVRFALTKPVERIKEAVERMKKLQF

SEQ ID NO: 18468 - protein, 742 aa, Gluconacetobacter xylinus
MMMSRKLMLLSAVAFGGIVALSPGAQAREGQDAPATTATTADSRARDLLSHMTLQDKLSMVFTIDGGGTMGNAPIPPGGLGSAAYLKTPAGLPPLQISDAGLGLRNPSHVRPHGQAVGLPSGLATASTWDPDMARQGGAMIGAEAWRQGFNVLLAGGADLTRDPRGGRNFEYAGEDPLLTGRVVGATIAGIQSQHVISTLKHFAMNDLETSRMTMSADIDTEAMRESDLLGFEIAMEVGHPGSVMCSYNRVNDIYACENPYLLTKVLKQDWKYPGFVMSDWGATHSSARSALAGLDQESSGDDADARPFFREILARDVKDGRVPTSRVDDMAQRIVRSMYDVGLVDHPPVMQPLDVVTDTLTAQRDEEEGAVLLKNSGNLLPLSPTAHVAVIGGHADVGVISGGGSSQVDPIGAPAIGVVKGPGKKDWPGDPVYFPSSPYRMMQAEAPSAHLTYTSGADIARAADAARRADVAVVFVTQFSYEGMDTANAMTLDGNQDALVAAVARANPRTVVVMETGDPVMMPWLDNVGAVMEAWYPGSGGGAAIARLLYGKVAPSGRLPMTFPASPVQLAHPDIVGVTANSVFEMQFHTDQELVYDEGSEVGYRWFDHTHATPLFAFGHGLTYTTFAHDGLRVAHHGDDVVATFTVRNTGTRVGVDVPQLYVRLPDGGGRRLAGWQRVTLAPGESRELSVVLEPRVLAHFDEKHDRRNVPSGEYRIWLGSSAVDESQQVTFHLAGRNMAP

SEQ ID NO: 18469 - protein, 284 aa, Vibrio fischeri
RDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNRFEAISVRVPTVNVTAMDLSVTINTNVKVNDINQTIVNASRCTLHNIVDYTEAPLVSIDFNHDPHSAIVDGSQTRVS

SEQ ID NO: 18470 - protein, 658 aa, Zea mays
  unsure (1)..(658): unsure at all Xaa locations
MRLLLRRRRRFPPSETAAATMATAAAASTALTGATTAAPKARRRAHLXXXXXXXXXXXRCSAASPAMPMAXXATPLRPWGPTEPRKGADILVESLERCGVRDVFAYPGGASMEIHQALTRXXVIANHLFRHEQGEAFAASAYARSSGRVGVCXXXXXXXXXXXVSALADALLDSVPMVAITGQVPRRMIGTDAFQETPIVEVTRSITKHNYLVLDVDDXXXVVQEAFFLASSGRPGPVLVDIPKDIQQQMAVPAWDTPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFAGRAKIVHVDIDPAEIGKNKQPHVSICADVKLALQGMNALLEGSTSKKSFDFGSWNDELDQQKREFPLGYKTSNEEIQPQYAIQVLDELTKGEAIIATGVGQHQMWAAQYYTYKRPRQWLSSAGLGAMGFGXXXXXXXXXANPGVTVVDIDGDGSFLMNVQELAMIRIENLPVKVFVLNNQHLGMVVQWEDRFYKANRAHTYLGNPENESEIYPDFVTIAKGFNISAVRVTKKNEVRAAVKKMLETPGPYLLDIIVPPQEHVLPMIPSGGAFKDMILDGDGRTVY

SEQ ID NO: 18471 - protein, 547 aa, Lactobacillus plantarum WCFS1
MTKTASEILNNPFLNKGTAFTKEERQALGLTGTLPSKVQTIDEQATQAYAQFKSKPSRLEQRIFLMNLFNENRTLFFHLMDEHVVEFMPIVYDPVVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKCVSGEQYYDVIDKFVAAEQQLFPDSLLHFEDFGRDNAQVILDKYKDQIATFNDDIQGTGMVVLAGILGALNISKESIKDQKILSFGAGTAGMGIANQILDELMQAGLTEEEAKQHFYAVDKQGLLFDDTEGLTPAQKAFTRKRSEFSNADELTNLEAVVKAVHPTVMIGTSTQPGTFTESIIKEMAAHTERPIIFPLSNPTKLAEAKAEDLIKWTDGRALVATGIPADDVEYKGVTYQIGQGNNALMYPGLGFGLIASTAKVLNAETLSAACHALGGIVDTSKPGAAVLPPVAKITEFSQKLAEVVAQSVIDQKLNKEPIADAKQAVADMKWVPEYRAISK

SEQ ID NO: 18472 - protein, 325 aa, Glycine max
  unsure (1)..(325): unsure at all Xaa locations
RYFLSLEFLMVFCSLINVIYYLRVSLQWCFFYPLNIHVCDIHDKEGDAALGNGGLARLSACQMDSLATLDYPAWGYGLRYEYGLFRQIIVDGFQHEQPDYWLNYGNPWEIERIHVTYEVKFYGTVEEVEMNGEKHQVWVPGETVEAVAYDNPIPGYGTRNTINLRLWAAKPSNKFDLEAYNTGDYINSVVNRQRAETISNVLYPDDRNHQGKELRLKQQYFFVSASLQDIIRRFKEAHNNFDELPDKVALHLNDTHPSLSIAEIMRILVDEEHLVWNKAWDIACKVXSFTTHTVVAEGLEKIPXDLLGSLLPRHLQILYEINXKF

SEQ ID NO: 18473 - protein, 262 aa, Glycine max
  unsure (1)..(262): unsure at all Xaa locations
MDAGYNPRTVEEVFRDFKGRRAALIKALTTDVEEFYQQCDPEKENLCLYGFPSEHWEVNLPAEEVPPELPEPALGINFARDGMQEKDWLSLVAVHSDAWLLAVAFYFGARFGFDKADRKRLFNMINDLPTIFEVVTGTCLKHEKQVKEKSSVSNNSGSKSKSNSKAIICRASETQGRQSKPLQPKDEDEGLGXLGLEEEDNDEHGDTLCGACSESYAADEFWICCDICEKWFHGKCVKITPARAEHIKQYKCPSCSNKRARP

SEQ ID NO: 18474 - protein, 469 aa, Agrobacterium tumefaciens str. C58
MTTANDILKQIKDNDIKFVDLRFTDPKGKLQHVTMDVVCVDEDMFADGVMFDGSSIAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGLDGIKNKIHPGKPMDKDLYDLPAKELKKIPTVCGSLREALESLDKDRKFLTAGGVFDDDQIDSFIELKMQEVMRFEMTPHPVEFDMYYSA

SEQ ID NO: 18475 - protein, 224 aa, Oryza sativa
  unsure (1)..(224): unsure at all Xaa locations
LTHPEYYEEMGIKPPKGVILYGEPGTGKTLLAKAVANQTSATFLRVVGSELIQKYLGDGPKLVRELFRVAEEYAPAIVFIDEIDAVGTKRYDSNSGGEREIQRTMLELLNQLDGFDSRGDVKVIMATNRIDSLDPALIRPGRIDRKIEFPLPDEKTRRMIFKIHTGRMTLADDVDLEELIMAKDDLSGADIKAICTEAGLMALRERRMKVTXEDFRKSKELYSI

SEQ ID NO: 18476 - protein, 267 aa, Zea mays
MESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWSNMYFRSFWKNAQSKGQISGDSPPDPSHFMRNGSSPGSNFTGKLDDNHNIVTSAAASGAQDQAETDHMASGCYRSAETTANFTNNAMSQSQPQWTGPSPVDDCAVNSETLNNQQLVIDEGTIRVSKYYSQELLNSLTHA

SEQ ID NO: 18477 - protein, 567 aa, Solanum ptychanthum
PRKGCDVLVEALEREGVTDVFAYPGGTSMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 18478 - protein, 651 aa, Chlorobium tepidum TLS
MTNPDSPALSPVERSLAEIRLAELTAAKTCYSSPATWEDEVLYFLMLDRFSDCREHGGFNDVSGAPVVADGTRTTLLFRIEADANNADWQQWFEAGRGWCGGTIAGMRDKLGYLKRLGVTAIWVSPVFRQVTGSDSYHGYGIQNFLDVDPHFGTREELRDFVADAHQLGIRVILDIILNHAGDVFSYHDNQPYFYYQGWQWPVKGYRLNQGDAGSIPFSDGEAHLEISMEAAIWPVEFQSETTWTMKGEIRNWDVFPEYLQGDFCSLKDIDHGWAPDDPAESWDLEKRISLFRPSAALDHLIKVYRFWMAYADIDGFRLDTVKHMEPGAVRYFASAIHEFAQTLGKENFPIIGEITGGRSYAMQILDVTGLDAALGIGDLPDKLEFLVKGWRSPGNPDTSEQEGYFDLFCNSLLDGKNSHQWYSKHIVTMIDDHDQVGEQRKYHFCGDSPEGRKLLKAALGLNLATEGISCIYYGTEQAFNGADPRSDDHSWGDVFLRECMFGGPFGSLQSTGRHFFNEEHEVYRFAGRLAEFRKSEIALRRGRQYLRKVSATGSEDDFVYPQPVNGEMHWVVAWSRIFAETECLCAINTSLERELTVWAVVDHQLNPPGKTMRCVFSSSPEQEGEEIKAGPVCGSAVKITVPPGGFVIYR

SEQ ID NO: 18479 - protein, 254 aa, Shigella boydii
IVAAGIKEILLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLLE

SEQ ID NO: 18480 - protein, 259 aa, Triticum aestivum
RHEGIQIRLDSGHKTCPKTQQLLSHTSLTPNFVLKSLIAQWCEANGIELPKNKANSRDKKAAKSSDYDHAGLVSLMNRLRSGSQDEQRAAAGEIRLLAKRNVNNRICIAEAGAIPLLVNLLSSSDPRTQEHAVTALLNLSIHENNKANIVSSHAIPKIVEVLKTGSMEARENAAATLFSLSVVDENKVTIGGAGAIPPLINLLCDGSPRGKKDAATAIFNLCIYQGNKIRAVKAGIVIHLMNFLVDPTGGMIDEALTLL

SEQ ID NO: 18481 - protein, 535 aa, Solanum tuberosum
MAKNQLQVLNALDVAKTQLYHFTAIVIAGMGFFTDAYDLFCISLVTKLLGRIYYHHEGAPKPGILPPGISAAVNGVAFVGTLSGQLFFGWLGDKMGRKRVYGMTLMIMVICSIASGLSFGKTPSGVIATLCFFRFWLGFGIGGDYPLSATIMSEYANKKTRGAFIAAVFAMQGFGILAGGIVALVVSGAFKNAYPAPIYSVNNEGSTPQEADIVWRIILMFGAIPALLTYYWRMKMPETARYTALVAKNATKAASDMSKVLNVEIEAEDDKIEKIVAIQGNNFGLFSKEFLHRHGLHLLGTTSTWFLLDIAFYSQNLFQKDIFSKIGWIPHPETMNALDEVFKIAKAQTLIALCSTVPGYWFTVAFIDRMGRFAIQLMGFFFMTVFMFALAIPYNHWTKKENRFGFVVMYSLTFFFANFGPNATTFVVPAEIFPARLRSTCHGISAAAGKAGAIVGAFGFLYAAQSTDPSKVDAGYPTGIGVKNALIVLGCVNFLGMLFTLLVPESKGKSLEEMSKENEGEEEMTKVENAQTIPV

SEQ ID NO: 18482 - protein, 488 aa, Ectocarpus siliculosus
MPEDVQNRTRIKSERYESGVIPYAKMGYWDADYKLKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPFLGATVKPKLGLSGKNYGRVVYEGLTGGLDFLKDDENINSQPFMRWKERFLYCMEGVNRAAAATGEVKGSYLNITAATVEQMYERAEYAHAIGSVIVMIDLVIGYTAIQSMAIWARKAEVILHLHRAGNSTYARQKNHGINFRVICKWMRMCGVDHIHAGTVVGKLEGDPLMVKGFYNSLLLTHLKINLAEGLFFDMDWASLRKCVPVASGGIHCGQMHQLLYYLGDDVVLQFGGGTIGHPDGIQSGATANRVALESMVLARNEGRDYVGEGPDILRRAASTCGPLKAALDLWKDITFDYTSTDTPDFVEVATGSR

SEQ ID NO: 18483 - protein, 150 aa, Glycine max
  unsure (1)..(150): unsure at all Xaa locations
MVSRHLASSLFLCFLCFEISVSSLRLPGLDQDAKATHGSVLRLNRGGSSVKFDPTRVTQLSWSPRAFLYKGFLSEEECDHLIVLAKDKLEKSMVADNDSGKSIMSDIRTSSGMFLNKAQDEIVAGIEARIAAWTFLPVENGESMXILHYE

SEQ ID NO: 18484 - protein, 386 aa, Solanum tuberosum
MADMNQHPTVFQKAANQLDLRSSLSQDVHARYGGVQPAIYQRHFAYGNYSNAGLQRGQATQDLSLITSNASPVFVQAPQEKGFAAFATDFLMGGVSAAVSKTAAAPIERVKLLIQNQDEMLKAGRLSEPYKGIGECFGRTIKEEGFGSLWRGNTANVIRYFPTQALNFAFKDYFKRLFNFKKDRDGYWKWFAGNLASGGAAGASSLFFVYSLDYARTRLANDRKASKKGGERQFNGLVDVYKKTLKSDGIAGLYRGFNISCVGIIVYRGLYFGMYDSLKPVLLTGNLQDSFFASFGLGWLITNGAGLASYPIDTVRRRMMMTSGEAVKYKSSLDAFSQIVKNEGPKSLFKGAGANILRAVAGAGVLAGYDKLQVLVLGKKFGSGGA

SEQ ID NO: 18485 - protein, 487 aa, Pseudomonas putida
MRETKEQPIWYGKVFSSNWVEARGGVANVVDPSNGDILGITGVANGEDVDAAVNAAKRAQKEWAAIPFSERAAIVRKAAEKLKEREYEFADWNVRECGAIRPKGLWEAGIAYEQMHQAAGLASLPNGTLFPSAVPGRMNLCQRVPVGVVGVIAPWNFPLFLAMRSVAPALALGNAVILKPDLQTAVTGGALIAEIFSDAGMPDGVLHVLPGGADVGESMVANSGINMISFTGSTQVGRLIGEKCGRMLKKVALELGGNNVHIVLPDADLEGAVSCAAWGTFLHQGQVCMAAGRHLVHRDVAQQYAEKLALRAKNLVVGDPNSDQVHLGPLINEKQVVRVHALVESAQRAGAQVLAGGTYQDRYYQATVIMDVKPEMEVFKSEIFGPVAPITVFDSIEEAIELANCSEYGLAASIHTRALATGLDIAKRLNTGMVHINDQPINCEPHVPFGGMGASGSGGRFGGPASIEEFTQSQWISMVEKPANYPF

SEQ ID NO: 18486 - protein, 232 aa, Triticum aestivum
  unsure (1)..(232): unsure at all Xaa locations
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITRLLAVXIIFINVFGTLGYXRXREFWSSCFKLAAIIIFMIVAV

SEQ ID NO: 18487 - protein, 313 aa, Zea mays
  unsure (1)..(313): unsure at all Xaa locations
DPRGRPGRGFVRRIGDHEFCRMLADILRDNGLHYGGDNFDSRARTEIAYPTLHAXRGSAEFMFYRNPIADVLLTADELTAELIKKAARFHYXSTSLIAETCRTAHLRAMKIAKEAGALISYDPNLREALWTSREEVRTQILSIWDQADIVEDREVXLEVLTSIDSEEDDVVMQLRRTTMRLLLMTLGDQGCEYYARDFHGGAASIKVQQADTPGAGDAFVGALLQRIVNDPSSLQDEKXLVESPKFPNASGTVTSSKKGAIPSLPTKREVLQLIKEAWIIIVLSAMVFTSLYFFGLVRILTPPRTIHRSAASY

SEQ ID NO: 18488 - protein, 341 aa, Prochlorococcus marinus subsp. marinus str. CCMP1375
MRIGINGFGRIGRLVLRALWDRENIEITHINDPFGDAKGAAHLLEFDSVHGRWDKSISSDQNKLSIEGHSISFSQESDFTKVQWDETGIELILECSGKFKSPQTLNPYFDTLGMKRVVVACPVKGEIQGEDALNIVYGINHDLYKPNKHRLITAASCTTNCLAPVVKVVNQAFGIKHGSITTLHDLTNTQVIVDSFKPDLRRARSGSQSLIPTTTGSAKAIGMIFPELQGKLNGHAVRVPLLNGSLTDAVFELEKEVTQEEVNHVFKEASEGELKGILGYEEKPLVSIDYVNDSRSSIIDALSTMVVNKTQLKVYIWYDNEWGYSCRMADLVSHVIKLEKE

SEQ ID NO: 18489 - protein, 172 aa, Streptococcus mutans UA159
MDLKNYIATIEDYPQEGVTFRDISPLMANGNAYSYAIREIVQYATDKKIDMIVGPEARGFIVGCPVAYELGVGFAPVRKPGKLPREVIEAHYEKEYGIDTLTMHADAIKPGQRVLIVDDLLATGGTVKATIEMIERLGGIVAGCAFLIELDGLDGRQAIEGYDTKVLMNFPG

SEQ ID NO: 18490 - protein, 485 aa, Zea mays
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASELIRRPRSNYMETLQQDITASMRGVLIDWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 18491 - protein, 427 aa, Batrachospermum pseudogelatinosum
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAGTMENMYERAEFAKQLGSIICMVDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 18492 - protein, 438 aa, Actinobacillus pleuropneumoniae serovar 1 str. 4074
MLTQEKNDLNKSGLDITNDTLVLILAGGRGSRLYELTDRRAKPAVYFGGCRRIIDFALSNCINSNLLKIGVITQYAAHSLLRHLQRGWSFLPYERNQYIDMLPARQQLDENTWYRGTADAVYQNMSMMKSHYRPKYVVILAGDHIYKMDYTQMLRDHVESGAKCTVGCIEVPREQAVEFGVMAVNDKLKVKEFVEKPADPPAMPGRPDSSLASMGIYVFDADYLYKMLEQEAAVPGTSHDFGKDIIPKAVEEGVLYAHPFERSCKGRNATGAIYWRDVGTIDSYWAAHMDLVSEEPQLDLYDESWPIHGRPQQTAPARFYYNKQRQRTLDNSLIAGGCVITDAEISNSVLFNRVHVAEETIIEHTVILPQVSIGKNCVIKRAVIDRHCVIPDGLQIGVNPEEDAKHFRVSKGGIVLVTQGMLDKLQGITSNIKLHHTI

SEQ ID NO: 18493 - protein, 96 aa, Zea mays
VLVGSHPLTGGVLASLLFVESIGAIGVGGLLVGRSRGFLLLEVPALPVEGNDTTIWGSGESLMFLSAQSMAVGTIMDRWVSKYSDPIMATGWVYYP

SEQ ID NO: 18494 - protein, 303 aa, Triticum aestivum
  unsure (1)..(303): unsure at all Xaa locations
APPGPPSSPPTTPRRSPPPPGTPSTPTRTTTAAWSSGGARRGPPPSRPPPPRRPGPTSGTPSSPAAAQRNPASRPPPPRPRRPGARYRNDFRDSGGVEAQSVQELEGYAXYKAEETTXXVDGCLRVAEEMRDTASKTLLQVHQQGXQIRRTHAMAIDIDQDLSRGEKLLGDLGGLFSKKWKPKKNGAIRGPMLTRDDSFIRKGSHMEQRHKLGLSDRPRRSNARQFLSEPTSELEKVEVEKAKQDDGLSDLSDILTELKGMAIDMGTEIEGQTKDLGHAEKDFDELNYRVKGANTRTRRLLGR

SEQ ID NO: 18495 - protein, 328 aa, Chloroflexus aurantiacus
MRAMVFTAPGQPLEYRDLPVPTPQPEEVLIRVEACAVCRTDLHIIDGELPAPNLPLVPGHQIVGTIERLGERVTRWTVGQRVGVPWLGWTCGECRFCRDGRENLCDQAQFTGYTRPGGFAEYTVADQRFCFALPTDYDATAVAPLLCAGLIGYRALRLAGTGERLGIYGFGAAAHLMTQVARWQGREVFAFTRPGDTEGQRFARELGAVWAGSSTELPPVPLDAAIIFAPVGDLVPYALRAVEKGGVVVCGGIHMSQIPAFAYELLWGERVLRSVANLTREDGEAFLQIAPQIPVRTTVQTFPLTELNTALNALRQGKLQGAAVIQIS

SEQ ID NO: 18496 - protein, 342 aa, Ferroplasma acidarmanus
MHGGNIYDFARENQASLSSILDFSASISDFNRIKNFIIKKEYIENYPETNLAAYKKILAGNEFNPANISLVSGLTAFIHTFLASIKGNVIIISPSFTEYLKPQIEGKRIIIPFNVVNDHPEILSNFNFEALFLVYPDSPTGQLMSSSSIYSIIEIAMKKNSTVFLDESFIWFVNNREIMERELIEKYNNVIIGRSMTKILSIPGLRLGYIASNSTTIHNIEEKLEPWRINQAALAYIDGNIQDLSNVALSTETERNYLIKSLKNIGFRTVGKPRANYITFQLPASIDGSRLKAYLAGKNIMIRLLDDYNEFGSNYMRISVKKRVKNKVLINALNCYTGEIHG

SEQ ID NO: 18497 - protein, 217 aa, Chelidonium majus
  unsure (1)..(217): unsure at all Xaa locations
VKKAHEISVLCDAEVGLIVFSTKGKLFEFSSESSMDNILERYERQCFVEEELKATHPESEGNWSLEHTKLKARIEILQKNQRHFMGEDLDPLSLKELQNLEHQLDIALKHVRSRKNQLLYASIAELRKKEKALHEQNILLGKKIKQKEEQIAQWSAQQNDAQNSSSFLTQAPQNSQSFLTQALPSLTLRTGYYQTARVVVCEEDGARSNMXMPPWML

SEQ ID NO: 18498 - protein, 365 aa, Bacillus subtilis
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAATRKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 18499 - protein, 500 aa, Oryza sativa (japonica cultivar-group); identical to SEQ ID NO: 13716

SEQ ID NO: 18500 - protein, 157 aa, Rhodospirillum rubrum
MSSNPNQRSAPADFPPPAAKSDKDWRAILTEDQYRVMRHQGTEAAWSSALNGEKRSGAFLCAACQAPLFASDDKYDSGSGWPSFTRPVDKQAVDTSVDHKLIVPRTEVHCSACGGHLGHVFEDGPRPTGLRYCINGVALDFKPEAPQATASHTPTDD

SEQ ID NO: 18501 - protein, 454 aa, Hypnea charoides
GYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERFLYAMEGVNRSVAATGEIKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLAVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 18502 - protein, 122 aa, Triticum aestivum
  unsure (1)..(122): unsure at all Xaa locations
MAPTVMASSATSVAPFQGLKSTAGLPVSRRSNGASLGSVSNGGRIRCMQVWPIEGIKKFETLSYLPTXSTTEALLKQVXYLIRSKWVPCLXFNKVGFIFREHNASPWVLXWPYWXMWKLLSG

SEQ ID NO: 18503 - protein, 411 aa, Petroselinum crispum
MGNTDDVKAVKPEKLSSPPPPAAPDQSNSHVYPDWAAMQAYYGPRVALPPYFNPAVASGQSPHPYMWGPPQPVMPPYGVPYAALYAHGGVYAHPGVPLAASPMSMDTHAKSSGTNEHGLIKKLKGHDDLAMSIGNGKADSSEGEMERTLSQSKETEGSSDGSNENSKRAAVNGRKRGRDEAPNMIGEVKIETQSSVIPSPRAKSEKLLGITVATPMVAGKVVGTVVSPSMTSSLELKDSPKEHAVNSPAGGQQPSTMMPNDSWLHNDRDLKRERRKQSNRESARRSRLRKQAEAEELAIKVDSLTAENMALKAEINRLTLTAEKLTNDNSRLLEVMKNAQAERAADVGLGNNNEKKASTLSTANLLSRVDNAGSGDRDEGESDVYEKTTKSGAKLHQLLDANPRTDAVAAG

SEQ ID NO: 18504 - protein, 496 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPESFDFRQERFIRRWIEALSDPRITHEIRSIWISYWSQADKTLGQKLASRLNVRPSI

SEQ ID NO: 18505 - protein, 539 aa, Oryza sativa
MAAANGGDSKGFEVPKLEIKFTKLFINGRFVDAVSDRHHPPAPPKSSRRSSPSHRDGIPAAWPPRRAATEAWTTHRAMGWRRATRPSEEGRRYEEKKASPPPSLPATGFAAGGLQRRRGKTFETRDPRTGEVIAKIAEGDKADIDLAVKAAREAFDHGPWPRMSGFARGRILHKFADLVEQHVEELAALDTVDAGKLFAMGKLVDIPGGANLLRYYAGAADKVHGETLKMARPCHGYTLKEPVGVVGHIVPWNYPTTMFFFKASPALAAGCTMVVKPAEQTPLSALFYAHLAKLAGVPDGVLNVVPGFGPTAGAAISSHMDIDKVSFTGSTEVGRLVMEAAAKSNLKPVSLELGGKSPVIVFDDADLDTAVNLVHMASYTNKGEICVAGSRIYVQEGIYDAFVKKATEMAKKSVVGDPFNPRVHQGPQEEMSIAQEEIFGPVMALMKFKTVEEAIQKANSTRYGLAAGIVTKNIDVANTVSRSIRAGAIWINCYLGFDPDVPFGGYKMSGFGKDMGMDALEKYLHTKAVVTPLYNTPWL

SEQ ID NO: 18506 - protein, 352 aa, Brassica napus
MGSNEEGKTTQSDKPAQVQAPPPPPEQSNVHVYHHDWAAMQAYYGPRVAITPQYYNSNGHAAPPPPYIWGSPSPMMAPYGTPYPPFCPPGGVYAHPALQMGSQPQGPASQATPVVATPLNLEAHPANSSGNTDQGFMTKLKEFDGLAMSISNNKSGSGEHSSEPKNSQSSENDDSSNGSDGNTTGGEQSRKKRSREGSPNNDGKPSSQIVPLLRDESEKHAVTMGTPVMPTAMDFPQPFPGAPHEVWNEKEVKREKRKQSNRESARRSRLRKQAETEELSVKVDALVAENMTLRSKLGQLNDESEKLRLENQALLDQLKAQATGKTENLISGVDKNNSVSGTVVVRMRNSNS

SEQ ID NO: 18507 - protein, 486 aa, Kluyveromyces lactis
MGNLPSHSNRPHHKHPSTMSQNVKDVSMVDINEAMNERQDDTSNKVETPGASSNLTQSLSQMNIDDRNELTPQLSSRKSTLIFNDDFDDISNQHKHIEHQNNYDDGRIITDNEDEDEDVVNNIITGPSDGSASSLSADSPAASSHSEDGRHQNSAYTNNSQEQHANKVSGNHYDGNVQHPGPAINQQTQPVPERRPTMVPVEITWQQGGSKVYVTGSFTGWRKMIGLVPVTDKPGVFHIKLQLPPGTHRFRFIVDNELRFSDFLPTATDQMGNFVNYLEIVPPESIEMMNYELDAQQQTQQKQNMQNQQLSDNVSQSQKIRDQTIQSQVRRQPSQSKDGKLSARSQLALHIEEDPDDMGNGYTRFKEEQQLKTDYEYTQDIPAVFTDPSVMEQYYLTLDQQQNNQQNMSWLTPPQLPPQLENVILNNYNKNAEPGSENNSGALPIPNHVVLNHLATSSIKHNTLCVASIVRYKRKYATQILYAPLQ

SEQ ID NO: 18508 - protein, 354 aa, Ustilago maydis
MGNCLSSSDQKEAKDRSVAIDKQIEEDSRKFKKECKILLLGSGESGKSTIVKQMKIIHQNGYTKDELLLYRLTVIKNLVDSAQAMVLALRKFKMEPEMPENRENVDAILQYRVDADPGATLDHAMARKVDSLWKDPIVPAIMERSSEFYLMDSAAYFFDNVNRIGQSDYVPNENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 18509 - protein, 773 aa, Oryza sativa (japonica cultivar-group)
MSAMTTTPISARSVRWESDMPDIEEGGGGLERPLLRRRGTNTTSQMAIVGANVCPIESLDYELVENEVYKQDWRSRGKLQIFHYQILKWVLALLVGLIVGLIGFFNNIAVENIAGFKLLLTTNLMLQNRYKAAFLWFISCNAMLAAAAAALCAYFGPAAAGSGIPEVKAYLNGVDAPSILAPSTLFVKIVGSIFGVSAGFVLGKEGPMVHTGACVASFLGQGGSRKYGFTWNWLRYFKNDLDRRDLITCGAAAGVTAAFRAPVGGVLFALEEATSWWRSALLWRTFSTTAVAAMVLRSLIEYCRSGNCGLFGKGGLIMFDVSSQVTSYTTMDLAAVVLLAIVGGLLGALFNFLLNRILRVYSYINEKGAPYKIILTVVISLVTSCCSFGLPWLTACTPCPPELAASGHCPTIGRSGNFKNFRCPPGQYNAMASLFLNTNDDAIRNLFSGGTESEFGVPMLLAFFTAVYSLGLVTYGVAVPSGLFIPVILSGASFGRLLGKLLGVLTGLDTGLFALLGAASFLGGTMRMTVSVCVILLELTNDLLLLPLIMLVLLVSKTVADCFNKGVYEQMVRMKGLPYLEAHAEPCMRSLVAGDVVSAPLIAFSSVESVGTVVDTLRRTGHNGFPVIEDAPFAPEPELCGLVLRSHLLVLLRAKTFTADRVKTGAAEVFRKLAPFDFAKPGSGKGLTVDDLDLTEEEMAMYVDLHPIANRSPYTVVENMSLAKAAVLFRQLGLRHMCVVPRTPGRPPVVGILTRHDFMPGYIRGLFPNVLRE

SEQ ID NO: 18510 - protein, 98 aa, Oryza sativa
PRFREERYSQLILWSGHTFVCLVDHVIIPTDHLHMDGFGVNTYTFFTRYAKARYVMFHWKPTCGVSCLMDDKATLVVGKNHFHASHDLYDFIVSGNFL

SEQ ID NO: 18511 - protein, 182 aa, Mesembryanthemum crystallinum
MASSMVSSAAVATVNRTPAQASMVVPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELREAKKAYPEAFIRIIGFDNVRQVQCISFIAYKPASYDA

SEQ ID NO: 18512 - protein, 478 aa, Bifidobacterium longum DJO10A
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENSMQRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLAPTPLEYELYFHI

SEQ ID NO: 18513 - protein, 387 aa, Gaeumannomyces graminis var. avenae
MLRSSAFALLAWASLSEAQFGIKHTQYGTSEPVYPSPEISGSGGWEAGLAKAKDFVAQLTPEEKANMVTGTPGPCVGNIAPVPRLNFTGLCLQDGPATLRQATYVTVFPGGVSAASSWDKDLIYKHGVLMAEEFRDKGSHVILGPVIGPRGRSPYAGRNWEGFSPTSYLAGVMAEQTVKGMQSVGVQACTKHFIGNEQEEQRNPTAVDGKTVEAISSNIDDRTMHEAYLWPFYNAVRAGTASIMCSYQRINGSYGCQNSKTLNGLLKTELGFQGFVVSDWAATHSGVASIEAGLDMNMPGSLDFFAPTFESYFGKNITTAVNNGTLSSRRVDEMIERIMTPYFALGQDKNYPPVDGSTVSVGFSRPGFWNHEFPLGPMVDVRRNHHE

SEQ ID NO: 18514 - protein, 483 aa, Trichodesmium erythraeum IMS101
  unsure (1)..(483): unsure at all Xaa locations
MVKILLVEDNEMNRDMLSRRLIRKKFEVVIAINGVEGVEMSISEIPDIILMDMSLPELDGWEATKKIKANQQTKDIPVIAITAHAMTGDREKCLQAGCDDYDTKPVEFPRLLEKXXXXXXXXXXXXXXXXXXMKNDRGNVLVVDDNQFNRDLLARRVKRQGHMISSASDGFQALEMVRNHSFDLVLLDIMMPQMNGYQVLETLKADPALRHIPVIMISAVDDIDSIVRCIELGAEDYLSKPFNPILLKARINACLEKKRLRDQEQAYIKQLAEEQEKSEKLLLNILPAPIAQRLKQGEKTIADSFSEVTVLFADLVGFTKVSANLSPAELVELLNMIFSCFDQLADKYGLEKIKTIGDAYMVVGGLPTLRKDHAEAIAEMALDMLYQVKQISESQEKSLQIRIGLNTGAVEAGVIGTKKFAYDLWGDTVNTAHRMESHGIPGVIQVTEDTYGCLANKYIFQERGIINVKGKGMMKTYLLISRK

SEQ ID NO: 18515 - protein, 155 aa, Yersinia ruckeri
AVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTM

SEQ ID NO: 18516 - protein, 481 aa, Salmonella typhimurium LT2
MTIWENAMQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 18517 - protein, 224 aa, Ralstonia metallidurans
MEGNRSEGTRRDPRRRTGPGRSGRRPLSPGTGETNMLLMIDNYDSFTYNLVQYFGELGADVRTFRNDEITIEEIEALKPDHICVSPGPCSPHEAGISVPVLQHFAGKIPLLGVCLGHQAIGEAFGGKVIRAKQVMHGKVSTIETTQEGVFAGLPKHFDVTRYHSLAIERETLPDCLAVTAWTPDGEIMGVRHKTLAVEGVQFHPESILSEHGHALLANFIKAPR

SEQ ID NO: 18518 - protein, 300 aa, Triticum aestivum
GVLIVGVLAVVIGAAFCGIFAFSYYRRQKQKIGSSLEVSDSRLSTDHFQQKEACRRSASPLISVEYSNGWDTMSGGGCGSSGEVGDSFRFNLEEVECATQYFSEVNLLGKSGFAATFKGILRDGSVVAVKSLNKTSCKQEESDFLRGLKTLTMLRLENLVGLRGFCCSRGRGECFLVYDFMVNGCLSDYLYVNEGAEASVLDWPSRVSIIRGIAKGIEYLHSKKSNKPSLVHQNISAEKILLDHHFAPRLSVPGLHKLLADDVVFSALKASAAMGYLAPEYANTGRFTEKSDVFAFGIVV

SEQ ID NO: 18519 - protein, 191 aa, Yersinia pestis KIM
MLLLIDNYDSFTYNLYQYFCELGTEVMVKRNDELQLTDIEQLAPSHVVISPGPCTPNEAGISLAVIRHFADKLPILGVCLGHQALGQAFGARVVRARQVMHGKTSAICHSGQGVFRGLNQPLTVTRYHSLVIATDSLPGCFELTAWTERGGEMDEIMGIRHRTLPLEGVQFHPESILSEQGHQLLDNFLKN

SEQ ID NO: 18520 - protein, 877 aa, Vibrio parahaemolyticus RIMD 2210633
MNKIKILPLAIALALSGCGSDETTPIDTGSHVASPDWQDQIIYFLMIDRFNDGDSALNDQGQNEFDPTSDKKFSGGDLVGVSDKLSYIEDLGATSIWITPPVANQWWDAEQNYGGYHGYWARDFQKVDEHFGDMESYQALAREVHARNMFLIQDIVTNHVGNFFTYDDPYSYDPSLPCQGFRLIKNALPAGQELPYPLNMNECKTDGTGSYHWTPTITDHNDPVQEKTWQLSDLDDLNTSDPEVRAYLKESYRKWIREVGVDGFRIDTVKFVEHDFWSDFLHADDGVMTQAVDTGRDNFLTFGEVFETSTPYHTEGEEKMLTYIGESGSPKQLTSVLNFPLQATMTRVFASGQPTDYLRFRLEKMMEMFPNPYIMPNFIDNHDMPRFLSQGSVNDMKQALITMMSVPGIPVIYQGTEQAMSAARDAMFAGGYREDGNYVDSFDQNSEMYLFIQELAKLRTENKVMTRGEIKVIGSDKAGAGVFAFTRTLDNDEVLVVMNTSNSPMLMNQLDVEQAGGTVFKQQIMSNWADAPEQLVADENGHVTLELPAKSAVIYSKTSSNQSVNTPDLNIQLAQDWEGKTITGDIVIAGSANANEKLNLVVDGNLETAQTITVGADGQFSVTLSTRHFAIGEQQHRFAIYSTEKKAGIEDVNFVSNLSWSNTPDDTIDDAGDAQDGVGGPNGNYSLPTDPTFDKDNSQLAINKAEVFTVGSNVRLTFTMDKITDTWLPPNGFDHVGFTIFIDLPEEAATNLSELPKINASMPNGTWSRNAVVFGWQSSIYNTKGANATTWGEAVTPAPTVTVDKANNTISMDFASDALGRPESLDGIRFYVTTWDLDGLSATYRPLEQDKGPWNFSGGASDESKIWDDLPIITLSE

SEQ ID NO: 18521 - protein, 355 aa, Fusarium oxysporum f. sp. lycopersici
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 18522 - protein, 652 aa, Mycobacterium tuberculosis H37Rv
MVESGTGIPLPASCWSRTRSRRCMPKDSSPHWIWHSSAARAALYVRGKRRPDGQGRRSCALRNRGRTPATGPGPGQSPSPVGARQPALPSRRPLNPARSRTEVVMSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 18523 - protein, 338 aa, Chloroflexus aurantiacus
MDISREKLLWAYERMRLIREFEDRLHTDFAAGKIPGFVHLYAGEEAVAVGLCAHLRDDDFITSTHRGHGHCIAKGVDLRAMMAEIYGKATGACKGKGGSMHIADVDKGMLGANGIVGGGPPLACGAGLTAKIKGTDQVTVCFFGDGASNQGTTFEGLNLAGIWKLPVVFVCENNGYAETTSPRYSVSGQDIAARARGFGMPSIAIDGLDFFAVYEAAGEAVARARRGEGPTFIEAQTYRYYGHFEGDSIRYRTRDEEAHYRSLDCLHRFRQTVTAQGLLTAAELDEIDARARAAVEDAVRFAAESPLPDPAELLTDVYVDYPMSALWPFQEAAVAVRR

SEQ ID NO: 18524 - protein, 492 aa, Cucurbita pepo
MDPYKYRPSSAYNTPFCTTNSGAPIWNNTAVMSVGERGPILLEDYQLIEKIATFTRERIPERVVHRRGASAKGFFEVTHDISNLTCADFLRAPGVQTPVIVRFSTVIHERGSPETLRDPRGFAVKFYTREGNFDLVGNNFPVFFVRDAMQFPDVIRAFKPNPKSHLQEPWRYLDFCSYHPESLLSFAWFYDDVGIPINYRHMEGFGVQAYSLINKSGKARLVKFHWKPTCGVKSMMEEEAIRIGGTNHSHATQDLYESIAAGNFPEWRLYIQTIDYEDQNKYDFEPLDTTITWPEDVVPLQPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDPCRHAEKFPMPPNVLTGKRERCVIPKENNNFKQAGDRYRSWAPDRQDRFVKRFVEALSDPRVTDEVRNIWISYWSQADRSLGQKIASRLNVRPNI

SEQ ID NO: 18525 - protein, 378 aa, Triticum aestivum
PRVRASHVQEDELTMSSDDLLQAQLELYHHCFVYVKSMALGAATDLRIADAIHLRGGAVTLSDLAADTGIHPTKLSHLRRLMRVLTTSGIFSAEVQASGATVYKLTRVSRLLVGVGGERPRRCDLSPIVSVLVNPVPVTALFSIREWFTDGKSAASSLFEVAHGCTRWEMIAKDAGDDRVFNAGLDADSRFSMEIILREYSGVFGSVRSSLVDVGGAHGTVAAAIAKAFPHIKCTVLDLPVVVAGAPADDNLTFIAGDMFEYIPPADTVLLKWILHDWPDEDCVKILRQCKKAIPTRDAGGKVIIMDMVVGSAVSQQETVSKEAEVLFDVFMMYIDGIQREEHEWSKIFFEAGFSDYKITPVTGIRSIIEVYPIKYKY

SEQ ID NO: 18526 - protein, 143 aa, Triticum aestivum
  unsure (1)..(143): unsure at all Xaa locations
MASDGRVERIASSIRAIPNFPKPGILFQDITTLXVEARGFIFGPPIALAIGAKFVPIRKPRKLPGEVISEEYSLEYGTDKIEMHVGAVQPNDRVLIVDDLIATXRXLCAAAKLIERVGAKVVECACVIELPELKGPDKVGRHA

SEQ ID NO: 18527 - protein, 477 aa, Schizoseris liaoii
KNDRYESGVIPYAKMGYWDPEYVIKETDILALFRVSPQPGVDPVEASAAVAGESSTATWTVVWTDLLTACDLYRAKAYRVDPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPKMIKGFYDTLLQPFLDINLPEGIFFKQEWAALRKVTPVASGGIHCGQMHQLLDYLGNDVVLQFGGGTIGHPDGIQAGATANRVALEAMVIARNEGRDYVKEGPQILRDAAKTCGPLQTALDLWKDITFNYTSTDTADFVETPTANV

SEQ ID NO: 18528 - protein, 132 aa, Glycine max
  unsure (1)..(132): unsure at all Xaa locations
FRFRPRVRPRVRPRVRDGFMNLMHRHEEVNYFPPRYDPARHAEXRVPVPPRTLGGKREKCMIHKETNFKQPGERYRSWPSDRQERFVRRWVDALSDPRVTHEIRSIWISYWSQADRALGQKIASHLNLKPSI

SEQ ID NO: 18529 - protein, 683 aa, Chlamydomonas reinhardtii
MKALRSGTAVARGQAGCVSPAPRPVPMSSQTMIPSTSSPATRAPARSGRRALAVSAKLADGSRRMQSEEVRRAKEVAQAALAKDSPADWVDRYGSEPRKGADILVQALEREGVDSVFAYPGGASMEIHQALTRSDRITNVLCRHEQGEIFAAEGYAKAAGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPTDIQQQLAVPDWEAPMSITGYISRLPPPVEESQVLPVVRALQGAAKPVIYYGGGCLDAQAELREFAARTGIPLASTFMGLGVVPSTDPNHLQMLGMHGTVFANYAVDQADLLVALGVRFDDRVTGKLDAFAARARIVHIDIDAAEISKNKTAHVPVCGDVKQALSHLNRLLAAEPLPADKWAGWRAELAAKRAEFPMRYPQRDDAIVPQHAIQVLGEETQGEAIITTGVGQHQMWAAQWYPYKETRRWISSGGLGSMGFGLPAALGAAVAFDGKNGRPKKTVVDIDGDGSFLMNVQELATIFIEKLDVKVMLLNNQHLGMVVQWEDRFYKANRAHTYLGKRESEWHATQDEEDIYPNFVNMAQAFGVPSRRVIVKEQLRGAIRTMLDTPGPYLLEVMVPHIEHVLPMIPGGASFKDIITEGDGTVKY

SEQ ID NO: 18530 - protein, 288 aa, Mycobacterium smegmatis
MRGIILAGGSGTRLHPLTIGVSKQLLPVYDKPLVYYPLSTLIMAGIRDILVITTPADAPAFRRLLGDGSDFGVNLSYAAQNEPEGLAQAFLIGADHIGNDTVALALGDNIFYGPGLGTSLRRFEHVSGGAIFAYWVANPSAYGVVEFDADGKAVSLEEKPKTPKSHYAVPGLYFYDNTVIDIARSLKKSARGEYEITEVNQIYLNRGQLSVEVLARGTAWLDTGTFDSLLDASDFVRTIELRQGLKVGAPEEIAWRAGFIDDDQLATRAKELLKSGYGHYLLQLLDRE

SEQ ID NO: 18531 - protein, 585 aa, Pseudomonas aeruginosa UCBPP-PA14
MHAVDFIQDLAVIMLVAGVVTILFHRLRQPVVLGYIVAGFIIGPHTPPFGLIHDEDTIKTLAELGVIFLMFCLGLEFSLRKLFQVGATAFIAAFLEIVLMIWIGFEIGRFFEWSTMDSLFLGAILAISSTTIIVKALGDLKMKNERFAQLIFGVLIVEDILGIGIIALLSGIAVSGSVETGEVFSTVGKLSLFMIVALVVGILLVPRLLAYVAKFESNEMLLVTVLGLCFGFCLLVVKLEYSMVLGAFLIGAIMAESRQLVQIERLIEPVRDMFSAIFFVAIGLLIDPKILVEYAWPIALITVAVVLGKMFSCGMGAFIAGNDGRTSLRVGMGLSQIGEFSFIIAALGMTLKVTSDFLYPVAVAVSAITTLLTPYLIRAADPLSQHLANAMPQRMARIFGHYGDWLRSIQPQGDRAVLAAMIRRILLQVGVNLALVIAIFLAGGYFADTLSAWMSQWVAYDGLHKALIWGGALLVSLAFLIAAYRKLKALSMLLAELGVKPEKAGRHTARVRRVISEIIPLLSLAGMMVLLAALSSSILPPGELLIVVALVAGLVIAVLWRWLIRVHSRMQIALMETLDQEKGSH

SEQ ID NO: 18532 - protein, 404 aa, Methanothermobacter thermautotrophicus str. Delta H
MFLSELLPVRDAFRILDENQRFTEPETVDLLEAYHRVLADDIVSRFDSPPFDRSAMDGYAVRAEDTFGSSPGNPSTLRVTDSIGAGEVSGVDVGHGEAVRIATGAPIPAGADAVVMEEYTLQDGPDIRVLRPVAPSENVAPAGEDVRRGVTVLREGTLMRPQEIAMAASAGYSKVRVFRRPSVKVIVTGNELVDPSDDLEPGKVPNSNLYTLNALVESAGGSADPVHLPDDIDTVGEEIESSASEYDVIITTGGTAISRGDVVVDAVDGLGEVLFHGVALRPGKPVAFGMVSETPVFMLSGYPVAAMVQFDVFARYYLLRMQHLDYRHRAVKRRCRAKVASGPGRTDYLRAWADDEEVEPVQSRGSGIIRSMVGSNAYIVIDENLEGISAGEECDVLLFDSMVI

SEQ ID NO: 18533 - protein, 367 aa, Corynebacterium glutamicum ATCC 13032
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSLSKTSNLASYRAGYLVGDPALIGELTEVRKNLGLMVPFPIQQAMIAALNDDDQEAGQKLTYAIRRAKLMRALLESGFQVDNSEAGLYLWATREEPCRDTVDWFAERGILVAPGDFYGPRGAQHVRVAMTETDERVDAFVSRLS

SEQ ID NO: 18534 - protein, 136 aa, Mycobacterium tuberculosis H37Rv
MTRPKLELSDDEWRQKLTPQEFHVLRRAGTERPFTGEYTDTTTAGIYQCRACGAELFRSTEKFESHCGWPSFFDPKSSDAVTLRPDHSLGMTRTEVLCANCDSHLGHVFAGEGYPTPTDKRYCINSISLRLVPGSV

SEQ ID NO: 18535 - protein, 467 aa, Laurencia brongniartii
PYAKMGYWDPNYVVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLEPYLKVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 18536 - protein, 347 aa, Cytophaga hutchinsonii
MASVKEKAKDNTKTKVESAGAFTKETYLFWYEKMQLVRKFEEKTGQLYGQQKIKGFCHLYIGQEACAAGAVSALKKGDHYITTYRDHGQPLVLGTDPKAIMAEMYGKATGISKGKGGSMHIFDKAVNFAGGHGIVGGQIPLGAGLAFAEMYKGTDNLCVCYMGDGAVRQGALHETFNLAMLWNIPVIFVIENNGYAMGTSVQRTSNVTELYQIGESYDMPSEAVDAMSVEEVHLSVARAAERARSGGGPTLLEFRTYRYKGHSMSDPAKYRTKEELESYKAQDPIEKVRAVILEKKHATEADLEAIDAKIKATVEEAVKFAEESPYPDASEAYKDVYTQEDYPFIIE

SEQ ID NO: 18537 - protein, 314 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLLRMPWRSF

SEQ ID NO: 18538 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 18539 - protein, 427 aa, Batrachospermum pseudogelatinosum
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEAVNRAQAAAGEIKGHYLNVTAGTMEDIYERAEFAKQLGSIICMVDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 18540 - protein, 260 aa, Magnetospirillum magnetotacticum
MIDPGQLRLAATLFAEAPVSTACLQGRLVIDNQADGLLPRLFAIEYAALFDVVAPALAAWRMPIPLGGTSTHFRTPVLRSLCGWDAYNVTEDADLGLRMALAGYRVGDLPSTTFEEAPKHVRAWLRQRSRWMKGFLQTSFTHGRRPREVWRRLGPADSLCALAFVPGTVVSALFYPFMMAGSLNELILGGGAGDTILAQLTWAGAWMVFLAGLAAIWLPGLVGCLRRGWRDLVPFVVLLPFYHLLVSLAAWLRGARIAAR

SEQ ID NO: 18541 - protein, 345 aa, Micromonospora echinospora
MQRQRPPSRAGGDMDRLQSALALYEEAMGYTYAAALRAAAAVGVADHLVDGPRTPAELAAATGTDADALRRVLRLLAVRDVVRESDGRFALTDKGAALRSDSPVPARAGILMFTDTMFWTMSHRVASALGPERPAFADIFGSSLDAYFDGDAEVEALYYEGMETVSAAEHLILARAGDFPATGTVADVGGGRGGFLLTVLREHPGLQGVLLDRAEVVARHRLDAPDVAGRWKVVEGDFLREVPHADVHVLKRILHNWGDEDSVRILTNCRRVMPAHGRVLVIDAVVPEGNDAHQSKEMDFMMLAARTGQERTAAELEPLFTAAGLRLDRVVGTSSVMSIAVGVPA

SEQ ID NO: 18542 - protein, 554 aa, Geobacter metallireducens
  unsure (1)..(554): unsure at all Xaa locations
MSGARTPCRITTIRQVVLPLKGDVLMTPQEVVSFAKENGALMVDFKFMDFVGTWQHISVPITEFSEDTFEEGQGFDGSSIRGWQPIHASDMILLPDPDTAKMDPFVAVPTLSLICNVFDPITKEDYTRDPRNIARKAEAYLKSTGIGEIAFFGPEAEFFIFDEVRYDSSSNQSFYMVDSVEGAWNSGREEFPNLGYKPRHKEGYFPLSPTDSQNDLRNEMVMELQKVGIRVECQHHEVATGGQAEIDMRFSSLVDMADQLQWFKYVIKNVAYRNSKTVTFMPKPLYGDNGSGMHCHQSIWKNGQNLFAGDKYGGLSQMALWYIGGIIKHXXXXXXXXXXXXXXXXXPSVPSPTRPPTPTSVWCRASRPRLTWHTPAVTARHPSGSRCSPPTRRPSGSNTGPLTPPATATSPSPPCSWPASTASRTRLIRGSLSIRISTDFPPKSSRTFRPLPGPLKTPSTPSGTTTSFFSRVTSSPPTSSRSGSSTRWRPKSTRSGCVRFPLSSPSTTTSRPIGGTASSRKAGAIPPFFYPVAPCYEAKPFLTFRGRSGYYAPL

SEQ ID NO: 18543 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 18544 - protein, 88 aa, Zea mays
  unsure (1)..(88): unsure at all Xaa locations
MSGQQEEDKKPGDQSGGHINLKVKGQDGNEVFFKIKRSTQLKKLMNAYCYRQSVDFNSIAFLFDGRRLRGEQTPDXLEMEDGDEIDAM

SEQ ID NO: 18545 - protein, 590 aa, Oryza sativa
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVGCDIQKDSVVLKSSEHIGPAEIGLLATVGVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVIPADEIGLGRYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKIINMPGNPNAVAECMEALLPALKHALKQIKGDKREKHPRHVPHAEAAPVDQWDRSFRAASSGRGCSCEP

SEQ ID NO: 18546 - protein, 476 aa, Mycobacterium tuberculosis H37Rv
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPEHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 18547 - protein, 476 aa, Synechocystis sp.
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGPNGNSSYYFADSVEGRWNTGREEEGGNLGYKPGYKEGYFPVAPTDTAQDIRTEMLLTMAGLCVPIEKHHHEVASGGQNELGIKFDKFDKLVNSADNLIIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKANRLEFRCPDATSNPYLAFAAIVCAGIDGIKNQIDPGEPLDVDIYDLSPEELAKIPSTPGSLEAALEALEKDHQFLTGTGVFSPDFVESWIEYKLDNEVNPMRLRPHPYEFSLYYDC

SEQ ID NO: 18548 - protein, 205 aa, Triticum aestivum
  unsure (1)..(205): unsure at all Xaa locations
PPPSKLYTYIVQPWPPPVMASSATSVAPFQGLKSTAGLPVSRRSNGASLGSVSNGGRIRCMQVWPIEGIKKFETLSYLPPLSTEALLKQVDYLIRSKWVPCLEFNKLGSSSXEHNASPGYXMAGYWDNWKLPKFGCXTDATQVXINEVEGXQERITLDPYVRIIXGFDNMRQVQCVNLIAXKPTGCXDPXRLNTHHKGIYKVHCL

SEQ ID NO: 18549 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 18550 - protein, 439 aa, Ahnfeltiopsis devoniensis
  unsure (1)..(439): unsure at all Xaa locations
PGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSXXXXXXXXXXXXXXXXXXXXIAAXGETKGXYLNVTAATMEEMYERAEFAKQLGSIIVMIDLVIGYTAIQTMGXWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVIARNEGRDYVAEGPQILQDAAKTCGPLQTALDLWKDITFNYTSTDTADFVETPTANV

SEQ ID NO: 18551 - protein, 77 aa, Glycine max
  unsure (1)..(77): unsure at all Xaa locations
MVSSFTCLKSMAGFPTRKTNNDITSIACNRLRVQCIHVSPPIVKKKFDTFSYLPYLYYSQLSNEVXYLLTKGLIPFF

SEQ ID NO: 18552 - protein, 195 aa, Buchnera aphidicola
MANILLLDNVDSFTYNLVDQLRTHNNTVVVYRNTVDIKIILQTLAQWSNPILVLSPGPGTPYTAGCMLNLIKSVKGNIPIIGICLGHQAIIEAYGGSIKYTDEIFHGKVSLINHDGLEMFKGIPQPLSVARYHSLVCDEIPSCFTVNSSIHKMIMSIRHNVEYVCGLQFHPESILTPHGDQILKQIIDWASLKYI

SEQ ID NO: 18553 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 18554 - protein, 210 aa, Zea mays
  unsure (1)..(210): unsure at all Xaa locations
MDPYKRRAGSAFNAPCWATNSGAPVWDNDSSLTVGARGPILLEDYHLGEKLANGGRERVPERVVHARGASAKGFFEGTHDITHLTCADFLRAPGVQTPVIVRFSTVIHERGSPETLRDPRGFGGKVYTREGNWDLGGNNFPGFFIRDGIKFPDMGHALKPNPRXTHIQDNWRILDFFSHHPESLHMVSFLFDDVGIPADYRHMDGSRGAH

SEQ ID NO: 18555 - protein, 672 aa, ASPERGILLUS NIDULANS FGSC A4
MASNFSEDNIKELKYRLEAAAVQCSERCLYQSAKWAAEILDSIIPIDNYDTDPDSPMDITEPRPQNPYLRTQDPVEAALEAQEYHKYLLAKSYFDTREYDRCASVFLPPTISPVSLSTSSPQSKLKSSLRNRKSQGSPHAGLKDNDLKRSPYPKLSQKSLFLALYAKYLAGEKRKNEETEMVLGPADGGATVNRELPDLARGLEGWFAERQEKGVEDQNHGWLEYLYGVILIKGRNEEEARKWLIRSVHLNPFHWGAWQELNDLLASTEDLKQVVEHLPQNIMTLIFHVHCSQELYQATEDTYQTLSELENIFPTSAFLKTQRALLYYHSKDFEEASHIFTDILITSPHRLDSLDHYSNILYVMGARPQLAFVAQVATATDKFRPETCCVVGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRIEQSIKALKRALVAGSYYAEDPSQHGGRKILDPETLYQIATLYERLEDEEEAAAYMELTLQQETGGQPDEVSDVSDSEIEDDQSNTASTSGANQRRARRSPNDDEEEAYHGTGPTATTSKARLWLARWSLRHGDLERADQLAGELCQDGVEVEEAKALMRDVRARREAGA

SEQ ID NO: 18556 - protein, 393 aa, Zea mays
MALRLNDVALCLSPPLAARRRRRSSGRFVAVASMTSAVSTKVENKKPFAPPREVHVQVTHSMPPHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMRKKISMPAHLMFDGQDDKLFEHFSMVAQRLGVYTARDYADILEFLVDRWKVASLTGLSGEGNKAQDYLCTLASRIRRLEERAQSRAKKAGTLPFSWVYGRDVQL

SEQ ID NO: 18557 - protein, 312 aa, Pseudomonas aeruginosa
MTDTAKRPLYVPHAGPSLLEMPLLNKGSAFSTQERIDFNLQGLLPHNIETIEEQTERAYSQYNLCNTDLDRHIFLRSIQYNNETMFFRLLEEHLEEMMPIIYTPTVGQACQEFSKIYRTHRGLFISYPDRERIDDILRSATKNNVKIVVVTDSERNLGLGDQGIGGMGIPIASCPCTCGGISPAYTLPVVLDVGTNKPDLLNDPMYMAWRHERVSGAQYEEFVDLFIQAIKRCWPNVLLQFEDFAQTNAMPLLERYKDELCCFNDDIQGTAAVAVGTLLAACKAKGEKLSEQTVTFVGWPPPVAASPNRSSR

SEQ ID NO: 18558 - protein, 784 aa, Oryza sativa
MGGGGGGTPRSSIGHILPGAGFVAVGVWHLFNHVKLFSQRPDTYVAPAWFPVPGARYLELALIIAGSGVEFAMEMFVGHSTLLPFAADGSIPSDRLHNHEHAIICLSLAVYAAAALHLDRARAPARGTLGLLLVAAVFAQELLVFHFHSTDHAGVEGQFHWLLQVVVAACLATSLLGVGYPRSFAVGLARSACVAFHGLWLAVIGAMVWVPSLVPRGCELVREDGRDTVRCRSKESLHRAKALANLQFGWYLSFMTVFVVALYLYVSNRYPAAEEAAYAPLQKAGAGDGDDDGDDDAHKGGGAGVHGFAALEIEAGNVSCPETAPKHESRGWCIEAPRPITARHVASPFHTLPFPSLPFATALLPPLLLLASAFIPLPLFLAPTPKTLAAATAAAAAVCSSMYYYSLRGGACVYLVAAEAPPPPKEAAAEKVDGSPQPQPQAELRLRLPAEIDWDRLDKWRFFVLGAGLFSAVSTALYPAVVLKTRLQVAPSPAHAAASSLPPSAAAAATAILRSEGPLAFYRGFATSLAGTVPARALYMGALEATRSAVGPTALALGAPEPVASAAAGAPAGLAAAVAAQVVWTPVDVISQRLMVQGNPCPASRYRGGLDAFRKIVAADGLRGLYRGFGMSILTYAPSNAVWWATYSLSQKTIWSGIGCYLCEYGVGVQEIDAGEGDSSLQPGYKTVMVVQGVSAAMAGGASALVTMPLDTIKTRMQVMDGEGGEPITVGRTVRRLIKEGGWGACYRGLGPRWASMSLSATTMITTYEFLKRLSAKGHESSLP

SEQ ID NO: 18559 - protein, 316 aa, Piromyces sp. E2
MVKVAVLGAAGGIGQPLSLLLKSHPQVTELNLYDIVNSPGVAADLSHICTKAKVTGYKGQENLDAALAGCDIVVIPAGIPRKPGMTRDDLFNINAGIVKGLAEGIAKNCPKAFVCIISNPVNSTVPICAEVFKKAGTYDPKRLFGVTLLDMVRSSTFVSECKGTSPADTKVTVIGGHSGVTIVPLLSQVKGLTFTQEEVEALTHRIQFGGDEVVKAKDGAGSATLSMAYAAARFVDSLIEGAFMKKPVIECAYVESPLAVDDGCSFFASAIELGPSGAEKILPIGPLSEYEQGLYKACVEQLKANIAKGVNFVNQA

SEQ ID NO: 18560 - protein, 357 aa, Trichoderma atroviride
MAEFVRAQIFGTTFEITSRYSDLQPVGMGAFGLVCSARDQLTNQNVAVKKLMKPFSTPVLAKRTYRELKLFKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTAYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLAPYHDPTDEPVAEEKFDWSFNDADLPVDTWKIMMYSEILDYHNVEGVPQMEDQQFPPQ

SEQ ID NO: 18561 - protein, 645 aa, Synechocystis sp. WH 8501
MQTQDRLTQKQPLSLKDAITASQNYLLSLQYPQGYWWAELESNITLTAETVLLHKIWGTDKTRPLHKVEAYLRQQQREHGGWELFYGDGGEISTSVEAYMALRLLGVPQDDPALIRAKDFIISKGGISKTRIFTKFHLALIGCYDWKGIPSIPPWIMLFPDSFPFTIYEMASWARESTVPLIIVFNDKPVFSVDPVFNLDELYAEGVENVKYELPKNNNWGDIFLGIDQVFKFAEQVDLVPFRKEGLKAAEKWILNHQQETGDWGGIMPPMLNSLLAFRTLNYDVNDPSVKLGFEAIDRFSIEEDDTYRLQACVSPIWDTAWCVRALTDSGLEKDHFSLVKAGKWLLDKQVMEYGDWAVKNKAGKPGGWAFEFTNRFYPDLDDSATVVMALNGIKLPDEARKQAAINRCLQWIETMQCKEGGWAAFDLNNDQAWLNEVPYGDLKAMIDPNTADVTARVVEMLGSCDLEIESDRLNKSLNYLYKEQEKDGSWFGRWGVNYIYGTSGVLSALAVINPEKHKTQMEQGINWLLSCQNKDGGWGETCRSYNDPSLKGKGVSTPSQTAWSLIGLLDAGEALNKFETDAIERGVNYLLDTQTEEGTWEESEFTGTGFPCHFYIRYHFYRHYFPLIALGRYQNLSSEFGVRS

SEQ ID NO: 18562 - protein, 411 aa, Ralstonia metallidurans
MTQTAARPPMLTMAQALDALMAGVRPITDSETVDTLQANGRVLAAGVTSALRVPPADNTSMDGYVMRAADVPAPGTRLPVSQRIPAGHVGTELAPGTAARIFTGGLIPPGADAVVMQEQCQADGDAVIVNHAPASGEWIRRAGEDIEAGSEILPAGTRLSPQALGLAASVGQAKLDVVRRVRVAVFFTGDELAMPGEPLKPGAIYNSNRFTLRGLLENLGCEVTDFGIVPDTLAATRDTLRRAAEGNDLIITSGGVSVGEEDHIRPAVTAEGRLDLWQIAIKPGKPLAFGQVANGTELPAFFLGLPGNPVSSFVTFLLFVRPFILRLQGVADVTPRRLPLRADFDLPRGDRRNEFLRARINDAGGLDLFPNQSSGVLTSTVWGDGLIDNPPNQTIQRGDVVQFIPFASLLA

SEQ ID NO: 18563 - protein, 463 aa, Nannochloropsis oceanica
EMGYWDANYTIKDTDVLALFRITPQPGVDPIEAAAAIAGESSTATWTVVWTDLLTACDVYRAKAYKVDSVPGTSDQYFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLVGSVIIMIDLVIGYTAIQSMAVWSRKNDMILHLHRAGNSAYARQKNHGINFRVICKWMRMAGVDHIHAGTVVGKLEGDPLMVKGFYNVLLQTSLDINLPQGIFFEQDWASLRKTLPVASGGIHCGQMHQLLNYLGEDCVLQFGGGTIGHPDGIASGATANRVAMESVLLAKYEGKDYINEGPKILRAAAESCAPLRSALDLWKDIAFNYTSTDTADYIETATKQ

SEQ ID NO: 18564 - protein, 503 aa, Neisseria meningitidis MC58
MKWLKRLTVIVGTFYRYRLAGLCASLMGSGWICALLKMMPQSSKLKNEPPAVRLRLALESLGPIFIKFGQVLSTRPDLIPHDYAVELAKLQDKVPPFDARLSREQIEKSLGQSIEKLYAEFETEPIASASIAQVHKARLHSGEQVAVKVLRPNLLPVIEQDLSLMRFGAGWVERLFADGKRLKPREVVAEFDKYLHDELDLMREAANASQLGRNFQNSDMLIVPKVFYDYCTSDVLTIEWMDGTPVSDIAKLKADGIDLHKLADYGVEIFFTQVFRDGFFHADMHPGNILVAADNRYIALDFGIVGTLTDYDKRYLAINFLAFFNRDYRRVATAHIESGWVPADTRAEELEAAVRAVCEPVFNKPISQISFGLVLMRLFEVSRRFNVEIQPQLVLLQKTLLNIEGLGRQLDPDLDLWKTAKPFLVKWMNGQVGPKALWRNLKNEAPDWAQIIPSLPRKISALIDENRQQEMRDAYIHLVKVQQRQSLWLAVIAVVLLLILLLK

SEQ ID NO: 18565 - protein, 474 aa, Candidatus Blochmannia floridanus
MFKQQEVGVIGMGIMGQNLALNIENKGYRVSIYNRSPDKTNIIIKNNPTKNLIPYFSIEQFIFSLKKPRVIFLMITAGVHVDHIIQVLSNYLEIGDILIDGGNSFYQDTVRRDLYLSEKKINFIGLGISGGEEGALKGPSLMPGGSQDAFKIVESLLKKIAARFNDNEICMEYIGPNGSGHYVKMMHNGMEYGDMQIISEIYFFLKMVLHLTAKQLGKIFSDWNMGELSSYLIEITSHILMKSDNNQYCVLDYILDVADNKGTGLWSSKDALDLGVPSTMITESVFARYLSTLKNQRIQASKVFSNVFEGKVNFDLENIDIFVEKARKALYLSKIILYAQGFYQLKISSMTYHWNLNYQKIAKIFRAGCIIRSNFLQEIINIYSKTPKIENLLLDSYCVNIINNYQQDLRDIVTIGIDHGIPMPALSAAISYYDGFRSLMLPANLIQAQRDCFGSHTYKRIDKSGVFHTRWLSK

SEQ ID NO: 18566 - protein, 290 aa, Desulfovibrio desulfuricans G20
MLIRKVVIPVAGWGTRSLPATKNIPKEMLPVYNKPVVQYVVEEAMRSGLTDVVFVTNRDKTIIEDHFDYNLQLESVLERAGKTEMLRQVREVAEMVNIHSVRQKRQLGLGHAVLCAREVVHNEPFAVMVGDDLQFGMEPGIQQLINVAVAERLPVVGVMEVPADKVSRYGIISGEEISPGIFRVHDLVEKPAVSEAPSRLAIVGRYILTPDIFKVLENLSPGHGGEIQLTDGLKVLAQGRGLLAVKLRGMRFDAGDWAEYLTANIYFALQEEDLRDELVERLRPLLPFKC

SEQ ID NO: 18567 - protein, 365 aa, Cytophaga hutchinsonii
MVENVKSKALTGVITGDQVQDLFAAAKKAKLAFPAVNVVSTGTVNAVLETAKLANSPVIVQFSNGGGQFYAGKSLPNGKQEASIAGAISGAHHVHQVSELYGVGVILHTDHAAKKLLPWIDGLLDAGEAFYKVHGKPLYSSHMLDLSEEPLHENIEVCKRYLERMSKIGMTLEIELGVTGGEEDGVDNSGIHQDELYTKPEEVAYAYEELMKVSDKFTIAAAFGNVHGVYTSGSVKLEPKILRKSQDFIKANYGRTEENPLDFVFHGGSGSSQEEIREAIGYGVVKMNLDTDLQWAFWEGVLNYYKANEAYLQGQIGNPKGADQPNKKFYDPRVWLRKGEDTFVARLKKAFEDLNSFDANTKMGN

SEQ ID NO: 18568 - protein, 492 aa, Cucurbita pepo
MDPYRHRPSSAFNAPFWTTNSGAPVWNNNSSMTVGPRGPILLEDYHLVEKLANFDRERIPERVVHARGASAKGFFEVTHDITNLSCADFLRAPGVQTPVIVRFSTVIHERGSPETLRDPRGFAVKFYTREGNFDLVGNNFPVFFIRDGMKFTRHVHPLKPNPKSHIQENWRILDFFSHHPESLNMFSFLFDDIGIPQDYRHMDGSGVNTYTLINKAGKAHYVKFHWRPTCGVKSLLEEDAIRVGGSNHSHATQDLYDSIAAGNYPEWKLFIQTIDPDHEDKYDFDPLDVTKTWPEDILPLQPVGRMVLNKNIDNFFAENEQLAFCPAIIVPGVYYSDDKLLQTRIFSYADTQRHRLGPNYLQLPANAPKCAHHNNHHEGFMNFMHRDEEVNYFPSRFDPSRHAERYPHPPAVCSGKRERCIIEKENNFKEPGERYRSWTPDRQERFVRRWVDALSDTRVTHEIRSIWISYWSQADRSLGQKLASHLNVRPSI

SEQ ID NO: 18569 - protein, 467 aa, Oryza sativa (indica cultivar-group); identical to SEQ ID NO: 4510

SEQ ID NO: 18570 - protein, 574 aa, Vibrio parahaemolyticus RIMD 2210633
MTAMLSGAEMVVQSLIEENVEQIFGYPGGSVLDIYDALHAKTDQIKHVLVRHEQAATHMADGYARATGKPGVVLVCSGPGATNTITGIATAYMDSIPMIVISGNVPNSLIGNDAFQECDIVGVSRPVVKHSFLVKKAEDIPETIKKAFYISTTGRPGPVVIDLPKDVMNPQIKLPYQYPESISMRSYKPTTSGHKGQIKKALKSLIEAKKPVLYVGGGAVISGAHEHILELADKLNLPVVSTLMGLGAFPGTHKNSLGMLGMHGTYEANMAMHEADLIFGIGVRFDDRTTNNLEKYCPNAKVMHIDIDPSSISKNVKVDLPIVGSAEKVLTTMLGLLAEQDCGNDEAAITKWWDDIQVWRDRQCLSYETSSDRIKPQQVIETLHKLTNGDAYVASDVGQHQMFAALYYPFNKPRRWINSGGLGTMGFGLPAGMGVKFAMPEEEVVVVTGDGSIQMNIQELSTAMQYDIPVKIINLNNRFLGMVKQWQDIIYQGRHSNSYMSSVPDFAAIAEAYGHVGIRIETPDQLEEGLQKALDMKDRLVFVDINVDETEHVYPMQIKGEGMDKMWLSKTERT

SEQ ID NO: 18571 - protein, 57 aa, Brassica napus
DWLVEVSEEYKLASDTLYLAVNLIDRFLSNNYIEKRRLQLLGVTCMLIASKYEEIYP

SEQ ID NO: 18572 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGILGYNTLPLVSMDFNHTTEASHFDATLTKVVDGNMVKVFAWYDNEWGFSCQMLNTARRMFGLEVRP

SEQ ID NO: 18573 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLMGKNGVEERKSIGTLSA

SEQ ID NO: 18574 - protein, 503 aa, Ajellomyces capsulatus
MGADDTFNSYRYKDTPTYTDSNGCPVMDPESSQRVGENGPLLLQDFHLIDLLAHFDRERIPERVVHAKGAGAYGEFEVLDDISDITTINMLKGVGKKTKLVTRFSTVGGEKGSADSARDPRGFSTKFYTEEGNWDWVFNNTPVFFLRDPSKFPLFIHTQKRNPQTNLKDATMFWDYLSTHQEAIHQVMHLFSDRGTPYSYRHMNGYSGHTFKWLTPDGGFNYVQIHLKTDQGSKTLTNEEATKLAAENPDWHTEDLFRAIERGEYPSWTCYVQVLSPQQAEKFRWNIFDLTKVWPHSEVPLRRFGRLVLNKNPQNYFAEMEQAAFSPSHLVPGVEPSADPVLQSRLFSYPDTHRHRLGVNYQQIPVNCPLRAFNPYQRDGAMAVNGNYGANPNYPSTFRRMNYMPVKASQEHEKWTGAVLAKQLPVTDEDFVQANGLWQVLGRQPGQQANFVKNVAGHLCNAEQKVRKAAYGMFIRVNKDLGSSIESSTEALVASQAQSQPRL

SEQ ID NO: 18575 - protein, 180 aa, Triticum aestivum
  unsure (1)..(180): unsure at all Xaa locations
MAPTVMASSATSVAPFQGLKSTAGLPVSRRSNGASLGSVSNGGRIRCMQVWPIEGIKKFETLSYLPPLSTXGLLKQVDYLIRSKWXPCLDSASWXIFREHNXTPGYYDGVLACGTAYFGALTHTVSTSGGVKKIPDPIPHHPIDTCSGECSLSHGCRIGSQTPSKAKFILHPNAWFLHYF

SEQ ID NO: 18576 - protein, 352 aa, Glycine max
MEWHRGHTIGQGSSATVSTATCCGGVLAVKSSELPQSEPLKKEQKILSSLSSPYVVAYKGCDITMENNKLLFNLFMEYMPFGTLAQATRRCDGRLQEPAIACYTRQIVQGLEYLHSKGLVHCDIKGANILIGENGAKIGDLGCAKSAADSTGAIGGTPMFMAPEVARGEEQGCASDIWSLGCTVIEMVTGGAPWPNVEDPFSVLYHIAYSSEVPEIPCFLSKEAKDFLGKCLRRNPQERWKASELLKHPFIEKLCFNKEVLESNTSSPTSVLEQGYWSCVEESESLGDLIHKTRKFETLAAGRVRMLALSSGVPYWARHDDENWITARGNGVEGFANCGAETASSASHGLSH

SEQ ID NO: 18577 - protein, 84 aa, Zea mays; identical to SEQ ID NO: 15706

SEQ ID NO: 18578 - protein, 170 aa, Zea mays
  unsure (1)..(170): unsure at all Xaa locations
MAPTVMMASSATAVAPFQXLKSAASLPVARRSTRSLGNVSNGGRIRCMQVWPAYGNKKFETLSYLXPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 18579 - protein, 304 aa, Bradyrhizobium japonicum USDA 110
MNSLSPRAAVGLFLIVVLAWGVNWSVTKQLVQFLSPLWTSAIRSWIALAALFVILGLSNNLVIPERRDIPVVLSVALLHMTVFSVLVAAGVRFLPAGKAVVLGYTTPLWVAIAAPLIGNDTLTAPKVAGALLGLIGLAVILNPTSIDWTNGNVMLGAGMVILAAIAWAANIIYIRAHRWLASPLQLLIWQVLVATVVLSITAAIVDGIPHVNWSWRLVLLFLYSGLIGTALAYWAMSMVNKSISALTTSLGTTATPLVGIASAAVLLGEPIDLSLAVAAGLIVAGIGLATLGDRLLRSQAIARG

SEQ ID NO: 18580 - protein, 252 aa, Lactobacillus delbrueckii subsp. lactis
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGLTSEQVSKLVIAYEPIWAIGTGKTASSDQAEEMCKTIRETVKDLYNEETAENVRIQYGGSVKPANIKELMAKPNIDGGLVGGASLVPDSYLALVNYQD

SEQ ID NO: 18581 - protein, 521 aa, Rhodococcus sp. YK2
MTLSSLGDEYLATVPTGRSVTPHWESGAEFRDEIFVGGLWRRGTGSLIESVDPSSGKIFATLHGAVEADVDDAVDTGLCAVRQSGWADRLPHERAAVLHRIGALIDAEVEQIATLQTIDTGKTLSETRALARSAAATFRYVAAAVETMEGAVTPSRGSYLTMSTHEPMGVIGSITPWNSPIASDAQKIAPALGAGNAVVAKPPVWAPWVTLLLARICERAGLPAGVLSVLPGPGRTVGDAIVRHPGIAKVTFTGGTDTGRALAHVAAEKLMPITLELGGKSPTIVFEDADLDQAVAGIMFGVFSSSGQSCIAGSRVFVQRSIFDEFVNRLVTATNALELGPGTDPRTQVAPMVAFSHRDNVSAMVDEAVLQGAKVLCGGMIPDEPRLADGAYYLPTILSVTDNSAPICQQEIFGPVAIVLPFDNESDLVDQANDTVFGLACGLWTTDFPRAWRIAKAISAGTVWVNTYKQFSISTPFSGLKDSGLGTEKGRDGIRSYMNQKSIYIDTAGQPLPWARTADNR

SEQ ID NO: 18582 - protein, 452 aa, Cytophaga hutchinsonii
MTEKEIVDYIKNNDIQKIKFAFADIDGVLRGKLIHTDKFLDGLKEGLGFCDVVFGWDSADAGYDNVSATGWHTGYPDKLAQIDLSTFRLIPWENNTPFFLADYKNNDQTALPICPRTLLKRIAQECSAMGYHAAFAQEFEWFNFRETQQSLVEKNFHDLTPLTNGMFGYSILRPSLEDAYYNDLFDLLGAFDIPLEGLHTETGPGVYECAYFHDEVVRAADKATLLKTAVKEIANKHGIIATFMAKISDKLPGCSGHIHQSLWNTGKTENLFYDPNQEHNMSDLFKHYVAGQLYCLPHIVPMLAPTVNSYKRLVEGAWAPTTLTWGFDNRTTALRVLNHSKKTARLEQRVSGSDTNPYLAIAASLASGLYGIKHKLSLDVPPTTGNGYANKSNGSIASNLMDATQLMKNSSIAKELFGEAFVQHFTATREWEWRQFSKHVSDWEMKRYMEII

SEQ ID NO: 18583 - protein, 128 aa, Zea mays
  unsure (1)..(128): unsure at all Xaa locations
MGPTELRPSTSHDTTVTTTNAGAPVWNDNEALTVVPRGPILLEDYHLIEKVAHFARERILERVVHARGAFANGFFXCTHDVTSLTCADFLRAPGVRTPVIVRFSTVIHERRSTETIRDLRRIVLKFYT

SEQ ID NO: 18584 - protein, 431 aa, Arabidopsis thaliana
MGSEQDQRKRWGGCLGVFSCFKSQKGGKRIVPASRIPEGGNVSASQPNGAHQAGVLNNQAAGGINLSLLAPPSSPASFTNSALPSTTQSPNCYLSLAANSPGGPSSSMYATGPYAHETQLVSPPVFSTFTTEPSTAPFTPPPELARLTAPSSPDVPYARFLTSSMDLKNSGKGHYNDLQATYSLYPGSPASALRSPISRASGDGLLSPQNGKCSRSDSGNTFGYDTNGVSTPLQESNFFCPETFAKFYLDHDPSVPQNGGRLSVSKDSDVYPTNGYGNGNQNRQNRSPKQDMEELEAYRASFGFSADEIITTSQYVEITDVMDGSFNTSAYSPSDGQKLLRREANLLSQTSPKSEADLDSQVVDFQSPKSSNSYKDHKQRNRIHADEEALLSRVGSVKGSRSYHISSSDAEVEYRRGRSLRESRENRHRKA

SEQ ID NO: 18585 - protein, 533 aa, Hordeum vulgare subsp. vulgare
MARQQLQVLHALDVARTQRYHAWAVVIAGMGFFADAYDIFCITLVTKLLGRIYYHVPGQPDPGMLPRRIEAAINGVTFCGMIVGQLLFGWLGDKVGRKMFYGKTIMLMIMGSFLSGLSFGNTADGVMATLCFFRFWLGVGIGGDYPLSATIISEYSNKRSRGSLIAAVFAMEGFGILAGCIVTLVVSATFQARFNPPAYEEDPMASVPPQADYVWRIILMVGAIPAVFTYRWRVMMPETARYTALVARDAEKAARDMSKVLKVEFTGEQDKIESFTRDRDYGVFSRRFARRHGWHLVGAVASWFVLDIVFYSQIILQEEIFRDVKWIPEARTMSALEEAYRVARGQAIIALCGTLPGYWFTVAFVDVVGRKAIQFLGFTMMKGLMLVVAAFYHHLTQPGRRIWLVVMYAFTFFFANFGPNSTTFIIPAEIFPAHVRTTCHGISSAAGKVGAIVGTFGFLYASQRADGSNEVKSGYPSGIGVRASLFVLAACNVLGIIFTCLLPEPNGRSLEEVSGEPINREDADLGDSRVLPL

SEQ ID NO: 18586 - protein, 661 aa, Arabidopsis thaliana
MHGRPRNASKPEEEAASAAKAVQLRSLQSQFMTNHHDKIYTNEAIELSTKLLEINPEAYTAWNYRKLAVEDRLARIEPDPNLVSAILDEELRVVESALRQNFKSYGAWHHRKWVLSKGHSSVGNELRLLEKFQKLDSRNFHAWNYRRFVVELTNRSEQDELQYTDDMINNNFSNYSAWHNRSVLLSSLLAQNADGFMPNIKIPEEYDFVHSAIFTEPDDQSGWFYHLWLLDQTLNVETPLLTSSWPSHGSSIILSGAGCLSGSSSMFTTFCSESGSFPLILYFDQAVGGVSSSTVTIDSELKGNEGLVWEPIPNKNSQVSCVWVARLKYVSSDPCEYKVKIRVGNSPGIVSSRGYNFNAPYEFVFTAHVHDTVEDSQEGIVSWTDGFDIWDAKSKDLNSLVTLDRLNAEMDFKWRQEAIDSEVECFGILPDSKIGKLTLARLLMAREAMVSDDAVKGVHYEEILQLYNDLMALDSSHYQYYKDEHSKAFLHKRMFMQVTSSSESLSRHLLRYRDMNNLVCLRLNNLSLSRIASVEKLLFVQMLDLSHNELHSTEGLEAMQLLSCLNLSHNRIRSFSALDSLRHVKQLKVLDVSHNHIGKHSVDTTRYLCSSPLSNSELGQDDVGKQNPGLVTKYWDAYCVLTDLNLKQLDIAGNEIAGEEF

SEQ ID NO: 18587 - protein, 433 aa, Caldococcus noboribetus
MVSHPCTADEAKPPSEGQLARFENGKLIVPDNLIVAYFKGDGIGPEIVESAKKVLDAAVDKAYGGTRRIVWWEVTAGEEAQKECGSLLPDGTLQAFKLARVNLKGPLTTPVGGGFRSLNVTLRMVLDLYSNVRPVKWYGQPTPHCHPENIDWVIFRENTEDVYAGIEWPFDSPEAQKIRDFLKKEFGIELTPDTGIGIKPISKWRTQRHVRRAMEWAIRNGYKHVTIMHKGNIMKYTEGAFRQWAYDLILSEFRDYVVTEEEVNTKYGGKAPEGKIIVNDRIADNMLQQIITRPGEYNVIVTPNLNGDYISDEANPLVGGIGMAAGLDMGDGIAVAEPVHGSAPKYAGKNVINPTAEILSGMYLLSDFVGWPEVKLLVEYAVKQAIAHKQVTYDLAREMGGVTPISTTEYTDVLVDYIRHADLKPSRASEGLP

SEQ ID NO: 18588 - protein, 680 aa, Glycine max
  unsure (1)..(680): unsure at all Xaa locations
ICALADRCDQKGLSVNERLGRMAETLEKMMESCTQKDTQQMAGSTDVAKVSNSSMTEESDVPSPKLRDWSRLPCLXWDRGSEDMLDCFPEADNSVFMDDLKGLPLMSCKTRFGPKSDQGMTTSSAGSMTPRSPLMTPRTSQIDLLLAGKGAYSEHDDLPQMNELADIARCVANAPLDDDRTTSYLLSCLDDLRVVVDRRKFDALTVETFGTRIEKLIREKYLQLTEMVDVEKIDTESTVDDDILEDDVVRSLRTSPIHSSRDRTSIDDFEIIKPISRGAFGRVFLAKKRTTGDLFAIKVLKKADMIRKNAVESILAERDILITVRNPFVVRFFYSFTCRENLYLVMEYLNGGDLYSLLRNLGCLDEEVARVYIAEVVLALEYLHSLRVVHRDLKPDNLLIAHDGHIKLTDFGLSKVGLINSTDDLSGPAVNGTSLLEEDETDVFTSADQRERREKRSAVGTPDYLAPEILLGTGHGFTADWWSVGVILFELLVGIPPFNAEHPQIIFDNILNRKIPWPAVPEEMSPEALDLIDRLLTEDPNQRLGSKGASEVKQHVFFKDINWDTLARQKAAFVPASESALDTSYFTSRYSWNTSDGFVYPASDVEDSSDADSLSGSSSCLSNRQDEVGDECGGLTEFDSGTSVNYSFSNFSFKNLSQLASINYDLTKGWKDDPATNSSA

SEQ ID NO: 18589 - protein, 139 aa, Triticum aestivum
VPLSRSMPRGDSIRNQGPLLNRPSTVQKASSINTRLLPQGSGAALIGKSALLGTGVPPSRPLSFTPGPAPAQTTPSPKPLIAAPAVAPAPDKPASAPKGNSAELQKKTIALLEEYFGIRILDEAQQCIEELQSPGYYPE

SEQ ID NO: 18590 - protein, 249 aa, Xylella fastidiosa Temecula1
MRPKIVAGNWKLHGSHAFAQALVAQVAAGLPLPGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 18591 - protein, 337 aa, Zea mays
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTSCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 18592 - protein, 333 aa, GIBBERELLA ZEAE PH-1
MSSTTKAPELELSQFLKTVLPQDDRSSLRESVIPQLLDAVSAIGDELRRSYDVSIVGTENAFGDEQLNVDVLAENIIRDRCAKSPAIKTASSEEDPVEKPAREGETVQPISDDEQYTIGFDPLDGSSIIGPNWSVGSIIGIWDGVTAIEQPTEKQIASILGVFGPRTLAIVALRVPSSDPVCFEVSLNNSHMFTVARPELRFAEPPFKTRYFAPANLRAAAENDKYMSLVTKFINDKYTLRYSGGLIPDVYHALVKGHGVYVSPVTSVSKAKLRKYYELLPVALVIECAGGQAIDPATGSRIFDITLKGCDDRAGLVCGTSEEVEVVKKALLD

SEQ ID NO: 18593 - protein, 175 aa, Oryza sativa; identical to SEQ ID NO: 12583

SEQ ID NO: 18594 - protein, 291 aa, Streptomyces spectabilis
MRGIILAGGTGSRLWPVTQAVSKQLMPVFDKPMVYYPLSTLMLAGIRDILVITTREDEIDFRRLLGDGSHLGLRLTYRTQDRPGGIAEAFLIGADFIGGEPVALILGDNIFHGRSFGVHVREHTAPDGGRIFAYPVADPTAYGVVEIGEDGTALSIEEKPAKPKSRYAAVGLYFYDEHVVDIAAGLRPSERGELEITGVNEEYLRRGALSVTVLDRGTAWLDTGTFTAMVQASEYVRVIEERQGLKIGCVEEVAWRCGYIDDERLRALSGPLLKSGYGRYLLSLLDEEALL

SEQ ID NO: 18595 - protein, 331 aa, Candida albicans
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKVEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRLPTTDVSVVDLTVRLKKAASYEEIAPAIKKASEGPLKGVLGYTEDAVVSTDFLGSSYSSIFDEKAGILLSPTFVKLISWYDNEYGYSTKVVDLLEHVA

SEQ ID NO: 18596 - protein, 135 aa, Triticum aestivum
  unsure (1)..(135): unsure at all Xaa locations
MRDDPEDVDSRSIFVGNVDYSSSPEEIQAHFQSCGSINRVTILLDKFTGHPKGYAYVEFTEPSFVAQALVLNESVFKGRNLKVVPKRTNIPGMTRGKXRGGPRGRGYGGRGXTHQEESGYRGGFRGSRGRGYSPY

SEQ ID NO: 18597 - protein, 353 aa, Nostoc punctiforme
MTNYFRSNVDAMASYVPGEQPQRGTQIIKLNSNENPYPPSPAALAVLRNIEGEWLRRYPEPFGGEFRQAASKVLRVPSDWIIVGNGSDELLSVVIRACAEPGKKVVYPMPTYVLYRTLAEMQGAEIIEISYSEDYSLPLEEMVAVNGSVTFIASPNSPSGHLVAINELRQLANQLSGVLVIDEAYVDFTEENALALVKEYENVIIIRTLSKGYSLAGLRLGFGVANPKLLQGLFKVKDSYNIDAIACAIGTAAITDQAYKNACVAKIKASRNQLSTDLKQLGFHIWDSQTNFLLVQPPQRNAEYLYQQLKEQGILIRYFKQPGLDDKLRITVGTDEQNQVLVEALIYLLGTGD

SEQ ID NO: 18598 - protein, 638 aa, Zea mays; identical to SEQ ID NO: 14582

SEQ ID NO: 18599 - protein, 530 aa, Oryza sativa (japonica cultivar-group)
MAGEVAIDSGEKRLNELGYKQELRREMTLFKTLAISFSTMTLFTGITPLYGSSLRYTGPASLVWGWVVVSFFTWFVGFAMAEICSSFPTTGSLYFWAAHLAGPVWGPLASWCCAWLEAIGLIAGIGTQAFAGSQVLQSIILLCTGTNKGGGYLTPRWLFLLMYIGLTFIWAVLNTFALEVIAFLDLISMWWQVIGGTVIVIVLPLVAKTTQPASYVFTHFETAPEATGIRSSAYATILSLLVSQYSLYGYDAAAHLTEETKGADKNGPIAILSSIGIITVFGWAYILALTFSIQDFSYLFDPSNETAGTFVPAQILFDAFHGRYGSSAGAIALLFVIWGSFFFGGLSITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKV

SEQ ID NO: 18600 - protein, 423 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGRDFVNEGPQILRDAAKTCGPLQTALDLWKDISFSYTSTDT

SEQ ID NO: 18601 - protein, 368 aa, Neurospora crassa
MATHNIVVFGGNHCGPEVVLEAIKVLKAIETNSPSACKFNLQNHLLGGASIDKHNDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIVRIARLAGFLALAKNPPAKVWSLDKANVLATSRLWRKTVTDVISKEFPQLQLEHQLIDSAAMLLVKNPRALNGVVITSNLFGDIISDEASVIPGSIGLLPSASLGGIPDGKGKCNGIYEPIHGSAPDISGKGIVNPVGTILSVAMMLRYSLNLPKEADAVEAAVKAAIDNGTKTKDLGGNATTSDMGNAVVAELEKILKA

SEQ ID NO: 18602 - protein, 484 aa, Proteus mirabilis
  unsure (1)..(484): unsure at all Xaa locations
MEKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIKRGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 18603 - protein, 183 aa, Photobacterium profundum
MNTKQQQIAIVTGANGGIGKNYTRMMLDDGFRVVMAVRNEVAGSLVRDELLQSHPDAAIDILKVDMSSLSSIKAFSKQVKEKYSRIDVLAHNAGVYFFDNERRESTDGIELNLAVHVVGPYALTIQLLPLLKETQGSRVITMSSSEHHGAKIDLRDIQIKERFEEQGNMIAYSRSKWAGLGWH

SEQ ID NO: 18604 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 18605 - protein, 241 aa, Tradescantia virginiana
  unsure (1)..(241): unsure at all Xaa locations
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 18606 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 18607 - protein, 454 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKNTSLQQRSFVPRHYRKSFSSDSVSGYVFFTLVYCTYC

SEQ ID NO: 18608 - protein, 162 aa, Glycine max
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLGDLHMQALLLR

SEQ ID NO: 18609 - protein, 373 aa, Oryza sativa (indica cultivar-group)
MPTPSHLKNPLCFDFRAARRVPETHAWPGLDDHPVVDGGGGGGEDAVPVVDVRAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 18610 - protein, 307 aa, Streptomyces avermitilis MA-4680
MALGTASTRTDRARTVRDMLASGKTTYSFEFSAPKTPKGERNLWSALRRVEAVAPDFVSVTYGAGGSTRAGTVKETEQIVADTTLTPVAHLTAVNHSIAELRNIIGQYADAGIRNMLAVRGDPPGDPMGEWVPHPRGLTYAAELVRLIKESGDFCVGVAAFPEMHPRSADWEADVERFVDKCRAGADYAITQMFFHPESYLRLRDRVAAAGCETPVIPEIMPVTSVKMLERLPQLSNAAIPSVLQERILTAKDDPAAVRSIGIEFATEFCARLLAEGVPGLHFITLNNSTATLEIYENLGLHHPQQA

SEQ ID NO: 18611 - protein, 350 aa, Xanthomonas axonopodis pv. citri str. 306
MAARATDPSVAAGAAIAIAERSDCGPDGLPLPALCDAAEPVVLRGVARNWSLVQAGLRSADEAMALLRAHDTGRPLQYSYGGPEIGSRPFYRDDCSALNFQVQRGSVSTLLDAIAAHRDDPQPPTYYLASLPVDANLPGLRAHNDLDVAANGGQVQPSIWIGNRVIASCHYDALDNLACCAVGQRRFTLFPPEQVANLYPGPLDPTPGGQVVSMVDVAHPDLQRFPRFADALPHARSVVLEPGDALFIPSMWWHHVQSLHPFNVLINYWWSRAPAHLPAAMPALYHALWAIRDRPTAEKQAWRALFDYYVFGPAEQAGEHLPEPARHALGPIDPVLSRQLRAMLIGKLNR

SEQ ID NO: 18612 - protein, 370 aa, Agrobacterium tumefaciens str. C58
MSAFSRLTPLAVSLPSTVPFVGPEAIERSRGLKVEARIGANESGFGPAPSVLLAMRDAAAETWMYSDPENFELKEALAIHHGVARGNIAIGSGVDGLLGEIARLIVEPGTPVVTSFGGYPTFNYHVNGFGGKLVTTPYVDDHENLDGLLDLVIRENAPLVYFANPDNPMGSWWEASEVVAFARALPETCLLILDEAYCETGPISAVPAIDALIGQPNILRMRTFSKAYGLAGARVGYAIGTLGNVEAFDKIRNHFGMARISVAGALAALKDQAYLHEVVGKISDARDRISAIARNNGLSPLPSATNFVTIDCHRDGAYARAIVDGLMDHGVFIRMPGVAPLNRCIRVSAGTADKLDLFEQALPKVLKAIG

SEQ ID NO: 18613 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCAFVRQTIAGLSSKEVSEATRIQYGGSVKPNNIKEYMAQTDIDGALVGGA

SEQ ID NO: 18614 - protein, 318 aa, Oryza sativa (japonica cultivar-group)
MTRRCSHCSHNGHNSRTCPNRGVKIFGVRLTDGSIRKSASMGNLSLLSSAAGSTSGGASPADGPDAAPTAADGYASDDFVQGFSSATRDRKKGVPWTEEEHRRFLLGLQKLGKGDWRGISRNFVVSRTPTQVASHAQKYFIRQSNMTRRKRRSSLFDMVPDESMDLPPLPGGQEPETQVLNQPALPPPKEEEEVDSMESDTSAVAESSSASAIMPDNLQSTYPVIVPAYFSPFLQFSVPFWQNQKDEDGPVQETHEIVKPVPVHSKSPINVDELVGMSKLSIGESNQETESTSLSLNLVGGQNRQSAFHANPPTRAQA

SEQ ID NO: 18615 - protein, 64 aa, Zea mays
  unsure (1)..(64): unsure at all Xaa locations
MLFMHHCRYEEIPNLTSGCTEFVESAQQILEXRKLNQTLLANHTTLLDLLEIPQLMDTYATFIL

SEQ ID NO: 18616 - protein, 308 aa, Oryza sativa
  unsure (1)..(308): unsure at all Xaa locations
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKVXRQSDNLKFLQLEETDVISSXMFEKYGDLWHHNRVRKYLTSEDWPKSETDGRPWHGLSLLLRKYPEHFVINIRMSGGRSIEFVSLVSLQP

SEQ ID NO: 18617 - protein, 736 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIAGSPALISGHCRQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 18618 - protein, 759 aa, Halobacterium sp. NRC-1
MKLTVKPLKQKDAGRGLAAVDRDSMDELALENGDYVVIDGQGDHGRAVARVWPGYPEDDGDGVVRIDGRLRKEADVGIDDQVTVEPADIKPAGGVTVALPQNLRVRGNIAPMVRDRLNGRPVTAGQTIPISFGFGGMSTISGQQIPVKIAETEPSGTVVVSNDTEIQLSERPAEEIAPGAGEAAETGDPTPNVTYEDIGGLDGELEQVREMIELPMRHPELFQQLGIDPPKGVLLHGPPGTGKTLIAKAVANEIDAHFETISGPEIMSKYYGESEEKLREVFDEAEENAPAIVFVDELDSIAPKRGETQGDVERRVVAQLLSLMDGLEDRGDVTVIAATNRVDAIDPALRRGGRFDREIEIGVPDQDGRKEILQVHTRGMPLVEDIDLDDYAESTHGFVGADIESLAKEAAMNALRRVRPDIDLESDEIDAELLESISITEADFKRALNGIEPSALREVFVEVPDTTWADVGGLTDTKERLRETIQWPLDYPDVFSEMDLQSAKGVLLYGPPGTGKTLLAKAVANEANSNFISVKGPELLNKYVGESEKGVREVFEKARSNAPTVVFFDEIDAIAGQRGRATSDSGVGERVVSQLLTELDGIEALEDVVVVATSNRPDLIDDALLRPGRLDRHIHVPVPDADARRAILDVHTRDKPLADDVDLDVVAQRMDGFVGADVEALVREATMNATREFINSVDPADASDSVGNVRVTMAHFEAALGEVTASVDADVKENYEEIEQRFNTADTPTDDEPASGAFR

SEQ ID NO: 18619 - protein, 378 aa, Solanum tuberosum
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 18620 - protein, 490 aa, Pseudomonas fluorescens PfO-1
MDEGGGPMMNFPTTLDGLYINGQWSAGREHLRVINPATEALLTTVNGGDESAVHQAVTAATEAFKAWSKTTGAERASILRNIANGVRNGREHLMNLQSSNNGKPQFEAGIDVDDVIATFEYYAELAEGLDAKLDSNVPLPSDDFSARLRREPCGVVGLIVPWNFPMVTTAWKLAPALAAGCCVVLKPSEVTPLPELELATIIAESGLPKGVFNLVCGTGLAVGAPLSADPRIAKVSFTGSNAVGVQVMQRAAETVKGVSLELGGKSSLLILEDADLDLAVELACGGGFFNAGQMCSATSRVLVADELADEFLIRLKAHAEKIRVADPFDPEVEMGALVNQAQYQRVLGHIDRGLSAGAKLICGGNRPADLPRGYFLQPTIFTEVPLDSALWCEEIFGPVICVRSFATEAEAIALANDSQFGLVASVVTRNAETADRVANALQAGLVWLNAPQVIFPQTAWGGYKQSSIGRELGPWGLAAFQEIKHVIRAL

SEQ ID NO: 18621 - protein, 168 aa, Nostoc punctiforme
MTQQPHPDLLGITVTCAVVTVSDTRTPETDKSGQLIQQLLFGANYAVGAYTIIKDEPTQIQEQIENLGKSSNLDAVIFNGGTGIAPRDTTYDAIEKLLEKTLPGFGELFRFLSYQEIGSRAIASRAVAGVYQDKLIFSLPGSSNAVRLAMEKLILPELTHLVSQVCKA

SEQ ID NO: 18622 - protein, 126 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 18623 - protein, 294 aa, Photorhabdus luminescens
MSFFHANQREALNQNLAELEGQIRVSFEFFPPRTTEMEKTLWKSINRLSTLKPKFVSVTYGANSGERDRTHSIIKGIKEKTGLEAAPHLTCIDASRDELCEIARDYWKNGIRHIVALRGDLPENGEKPKMYGSDLVELLKKEADFDISVAAYPEVHPEAKSSQADLISLKRKIDAGANRAITQFFFDVESYLRFRDRCVAAGIDVEIVPGILPVSNFRQLKRFAVMTNVRIPSWMTRMFDGLDDDPESANLVGASIAMDMVKILSREGVKDFHFYTLNRAELSYAICHTLGVRP

SEQ ID NO: 18624 - protein, 450 aa, Phycodrys rubens
  unsure (1)..(450): unsure at all Xaa locations
DILALFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAASGEVKGHYMNVTAATMEEIYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPELEXNLPLGIFFKQDWASLRKVTPVASGGIHCGQMHQLLDYLGDDVVLQFGGGTIGHPDGIQAGATANRVALESMVVARNEGRPFVEEGLQILRDAAKTCGPLQTALDLWKDITFNYTSTDTADFVETPTANV

SEQ ID NO: 18625 - protein, 576 aa, Rhodospirillum rubrum
MGSIGSNIQKHSRGVCAVVQSSVASRTGGALLADSLIALGADTVYCVPGESFLPFLDAVHDRTDALRLVVCRQEGGASYMADAHAKMTGKPGVCFVTRGPGACNAAIGVHTAFQDCTPMLLFIGQVDRPMIGREAFQEVDMTAFFAPLAKFSATADSAARLPELVARAWAAATSGRPGPAVVALPEDVLAEMAFARDPLPRPPARPAPRAADMADLASRLAAAERPLVIVGGGTWTPRAAKLVTTWAEASGLPVVAAFRRQDVVDNLSPVYIGELGFSASPRLNARIKAADLIVCVGDRLGEVTTQGYSLIESPVPSQSLIHIFPDAGEIGRVYATDLGIVSAMEPFAEMLSPVDGRHWAGWLAQGRADYAANLRADPCPGSVDMAQVMAEIEARLPEDAVITNGAGNYSGWVHRFHRYRHFPSQLAPGNGSMGYGLPAAIAAKVVAPRRVVVAFAGDGCFLMNGQELATAVDQGLDPIIIVINNGMYGTIRMHQEKAYPGRVSGTSLTNPDFVALAQAYGALGLRVRRTAEFGPAFDQALVAGRPVLIEIHQDPEAISHRVSLTALREKALATSA

SEQ ID NO: 18626 - protein, 261 aa, Picea abies
MGRGRVQLRRIENKINRQVTFSKRRNGLLKKAYELSVLCDAEVALIIFSTRGKLYEFASSSMNKTLERYEKCSYAMQDTTGVSDREAQNWHQEVTKLKGKVELLQRSQRHLLGEDLGPLNVKELQQLERQLEVALAHLRSRKTQVMLDQIEELRQRERLLHEVNKSLQKKLSETEGRDVITGIEQTSNTNTGTNGPWDSSITNTAYALSHPQQNSNASLHHVDCEPTLQIGYQPVPPESIGPPHQPQHNQTQNQYMQGWWV

SEQ ID NO: 18627 - protein, 431 aa, Glycine max
  unsure (1)..(431): unsure at all Xaa locations
MEMERVFEFPHTHMDRRPRKRARLGWDIPEVPKAQVGLFCGQDVGTISSFAPSRGPSENTTSSLFVKPVARNGSPPWRDDDKDGHYMFALGENLTSRYKIHSKMGEGTFGQVLECWDRERKEMVAVKIVRGIKKYREAAMIEIEVLQQLGKHDKGGNRCVQIRNWFDYRNHICIVFEKLGPSLYDFXLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGGALFQTHENLEHLAMMERVLGPLPQPMLKRVDRHAEKYVRRGRLDWPEGATSRESIKAVMKLPRLQNLVMQHVDHSAGDLIHLLQGLLRYDPSERLTAKEALRHSFFMRDQFRR

SEQ ID NO: 18628 - protein, 406 aa, Lactobacillus plantarum WCFS1
MPMLTRRYPISITEAQAKINQVALPTKTETIPVTDANHRVLAETVTAPFAYPHFRRSGVDGFAIRHEDDHDYPHEFKVVGNIPAGSTFHQPLGKDEAVRIMTGADVPSDAGVVVMLEKTRELADNRINIVVPEKHSNITEIGEEYQTADVLIEKDTELNPGGLAGLTALGVQTVTVYRQPRVAVITTGSELMAPGEPVQEGKIYNSNGVQIPYLVRENGGVITNVEQLVDDNALLQASLTKAIAENDIVITDGGVSVGDYDFIGDTARQADELLFNKIKQRPGSVTTAFVQDNTLVMALSGNPGACFTAFYLYVEPLLRRFVHQPSRIKKVQSRLAAPYHKTNGFDRILRATFTEDHGQYATYPNGPDRSGALSNLQTTTCLIKIPHSNRPIELNAEVETWLLPFK

SEQ ID NO: 18629 - protein, 820 aa, Agrobacterium tumefaciens str. C58
MINNLTAADLPRPAPRSSNPEIMAAEIIERLTYRIGKDVKVAKPHDWLTATILVVRDRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGIRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 18630 - protein, 174 aa, Triticum aestivum; identical to SEQ ID NO: 5594

SEQ ID NO: 18631 - protein, 795 aa, Arabidopsis thaliana
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQLYDSVNLLLSLQGEKGGLTAWEPVRAQEWLELLNPTDFFTCVMAEREYVECTSAVIQALVLFKQLYPDHRTKEIIKSIEKGVQFIESKQTPDGSWHGNWGICFIYATWFALSGLAAAGKTYKSCLAVRKGVDFLLAIQEEDGGWGESHLSCPEQRYIPLEGNRSNLVQTAWAMMGLIHAGQVQIFSILDLHLFQVQRNYLETPIVSSAVSIQQAERDPTPLHRAAKLIITSQLENGDFPQQEILGVFMNTCMLHYATYRNIFPLWALAEYRKAAFATHQDL

SEQ ID NO: 18632 - protein, 466 aa, Yersinia pestis KIM
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 18633 - protein, 488 aa, ASPERGILLUS NIDULANS FGSC A4
MAQVEVPSTNGSGKSVETRLFINGEFQPSSDGKTFSLIDPFTQNSVAEVSQATEEDTNNAVAAAKAAFPAWRDRSPADRGACLHKLAALIRENNEEFARLEALSTGRPVSRYFDATVSADTFSYFAEAGWTVQGTSSLNTPGHLNMTVKQPYGVVACIIPWNVPMAFFAFKVAPALAAGNTVVLKSSEKAPLTSALAATLIAEAGFPPGVINILSGFGTPAGSTLASHMDVRCLSFTGSSFTGQRIQAAAAASNMKIVHMELGGKSPALIFEDADLENAAQATQFSIQCLSGQTCMANSRIYVQESVADEFLALFKEKFGSAVLGNPLESGTTHGPQVDGLQYERVKSYITIGEQDGKLSMGGDAGNGYFVKPTVFEGVPEDSRIVKEEVFGPVVVINTFKTEEEAIKKANASEFGLYASVFTKDLDRAVRTSKLLEAGTVGVNTTSPNVAKDMPFGGYKMSGVGREGFMHSLDNFLETKTILIKMSS

SEQ ID NO: 18634 - protein, 289 aa, Glycine max
  unsure (1)..(289): unsure at all Xaa locations
MAKPRYSRLPPRKSSSSSTLILTLFLVFTFLVLILLALGILSIPSSSRGNLPKPNDLASIARNTIETSDSDERGEQWVEVVSWEPRAFVYHNFLTKEECEYLIDIAKPSMHKSTVVDSETGKSKDSRVRTSSGTFLARGRDKIVRNIEKKISDFTFIPVEHGEGLQVLHYEVGQKYEPHYDYFLDDXNTKNXGPPRAAVLMYLTDXEEGGETVFPAAKGNFSSVPWCNELSECGKKVLSIKPKRGDALLFWSMKPDASLDPSSLHGGCPVIKGNKWSSTKWMRVSEYNA

SEQ ID NO: 18635 - protein, 609 aa, Arabidopsis thaliana
MGCLRSLVRRKQFDSSNGKAETHHHHQQLAKALTFPHLIAIGVGSTIGAGVYILVGTVAREHSGPALALSFLIAGISAALSAFCYAELSSRFPSAGSAYHYSYICIGEGVAWLIGWALILEYTIGGSTVARGISPNLAMIFGGEDCLPTILARHQIPGLDIVVDPCAAVLVFIVTGLCCLGVKESTFAQGIVTTANVFVMIFVIVAGSYLCFKTGWVGYELPTGYFPYGVDGMLTGSATVFFAYIGFDTVASMAEEVKNPRRDLPLGIGISLLLCCLLYMMVSVVIVGLVPYYAMDPDTPISSAFSSHGIQWAAYLINLGAVMALCSALMGSILPQPRILMAMARDGLLPSYFSYVNQRTQVPINGTITTGVCAAILAFFMDVSQLAGMVSVGTLVAFTMVAISLLIVRYVVPPDEVPLPSSLQENSSSHVGTSIRSKQPLLGKVDDSVVDKENAPGSWVLNKKNRRKFAGWSIMFTCIGNFLLSYAASSFLLPGLLRYSLCGVGGLFLLVGLIVLICIDQDDARHSFGHSGGFICPFVPLLPIVCILINMYLLVNLGAATWVRVSVWLFLGVVVYIFYGRRNSSLVNAVYVSTAHLQEIRRTSGHSLA

SEQ ID NO: 18636 - protein, 288 aa, Zea mays
MEHDVHHQHQQAMELPPGFRFHPTDEELITHYLARKAADARFAPRAVGEADLNKCEPWDLPSRATMGEKEWYFFCVKYRKYPTGLRTNRATESGYWKATGKDREIFRSKALVGMKKTLVFYTGRAPRGGKTGWVMHEYRLHGKHASSSRLMPSSVRAGASKDEWVLCRVFKKSIEPPPSVGKRSSVACTGTMVVEDVVGPPSMSMEDDLTACALPPLMDVSGGGGANMAAASIELLAPPAPHVTCFSNALEGQFFLNPPCLHPSTSPLRLASMVQAQAQAQYDGDAGM

SEQ ID NO: 18637 - protein, 339 aa, Glycine max
MDHSADAHRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 18638 - protein, 425 aa, Zea mays
  unsure (1)..(425): unsure at all Xaa locations
MAAAAAAAAFDAYTDKTAVFRRLKAKPENKMCFDCNAKNPTWASVTYGIFLCLDCSAFHRSLGVHITFVRSTNLDSWTPDQLKMMAFGGNNRAHAFFKQHGWTEGSGKVDSKYTSRAAELYRQILQXKEVAKSAITDNALPSSPVTASEASKPPSDDFPEFKLPDVPAPPAENLNGKHEPKSPRAAPHSPKAATHPTFATSVKKPIGAKKVGGKTGGLGVRKLTTKPNESLYEQKPDEPKPAVPALAASTNKGGQALHSRFEYVENEPSADSRTGGSVSRVSGHVAPPKSSDFFQEYGMGNGFQKKSSNASKTQVEETDEARKKFSNAKAISSSQFFGTQNRXEEKEAQLSLQKFAGSSSISSADLFGRNDADXSNLDLSAADLINRISFQASQDLSSLKDIAGETGKKLTSLASNFISDLDRIL

SEQ ID NO: 18639 - protein, 176 aa, Glycine max
MPAPTVPEPPLFQVKAVLEVEKKVIEEDVVALKRKDSTEIPSPEEKPLVSARFTHRKFLKSSSEGGRALRVVAKAKRDETLESTWKAITEGRSMPLSRHMKKSDMWHNRNVTPQPQETFNDALSVSSGRLRKEPSLSQDELNRRVEAFIQKFNQEMRLQRQQSLEQYMQMINRGAA

SEQ ID NO: 18640 - protein, 350 aa, Neurospora crassa
MSTFTTNGAGAENDGEKVNTHIVTLTRFLTEEQVKHKEATGDFTLLCHALQFSFKSIAYYIRRATLVNLTGLAGSSNTTGDEQKKLDVISNDLFIEAMRSSGKCALLVSEEEEHVIYFKDAKNARYAVACDPIDGSSNLDAGVSVGTIFAIHKLAEDSTGTKEDILKPGTELVAAGFTMYGASAQLVITMKGGSVNGFTLDQGVGEFILTHPNMTIPRKRSIYSVNEGNSLYWEDDVKAYFNSLKETQEDSGKPYSARYIGSMVADAYRTLLYGGMFAYPADKKSPKGKLRILYECAPMAMIFENAGGQAVDSKMNRMLEVVPEHIHDKAGIFMGSYDEVEKVKKYHGKA

SEQ ID NO: 18641 - protein, 562 aa, Vibrio vulnificus CMCP6
MNNDKRPLYIPFAGPALLSTPLLNKGSAFSAEERISFNLEGLLPETTETIQEQVERAYMQYKAFESDMDKHIYLRNIQDTNETLFYRLVQNHITEMMPIIYTPTVGAACENFSNIYRRGRGLFVSYANRDRIDDILNNASNHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKNRICCFNDDIQGTAAVTVGSLMAACQAAGSKLSEQRITFLGAGSAGCGIAEAIIAQMVSEGISDKKARSQVFMVDRWGLLQEGMPNLLDFQQRLVQKHSVTAKWETEANGFSLLDVVKNAKPTVLIGVSGAPGLFTQEVIQEMHKHCPRPIVFPLSNPTSRVEAVPADIIRWTNGDALVATGSPFDPVIHEGKTYPIVQCNNSYIFPGIGLGVLAVNAKRVTDEMLMESSRALATCSPLAINGKGALLPPLEEIHTVSKRIAYAVAKKAIEQGVALEIADDALQVAIEQHFWQPVYRRYKRTAF

SEQ ID NO: 18642 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGNSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 18643 - protein, 63 aa, Aureococcus anophagefferens
MRGILVDWLVEVHLKFKMLQPTIYLTVQIIDRYLSAKQIDRNQLQLLGVAALFIASKYEEIYP

SEQ ID NO: 18644 - protein, 262 aa, Glycine max
  unsure (1)..(262): unsure at all Xaa locations
MATTTANKDETISTIASSSSPVFISTETLCTILTHHTLMNHFQSTLPKASTILQTPIRQHHSLSPSSSLLLMPSWSSSSSLPYIGVKLVTHFPQNSSLNLPGVQGSYVLFSSTTGQTLASMDSTELTLYRTSCVSGLASKYLARHDSEVLVMVGAGSLAPRLIKAHLSAIPSLRKVIIWNRTVGKATTLANKLSQSGEFGGVRFEGCGCLDEVVGFGDIVSCATNSETPLVKGEKLKGXAHLDLVXSXFKNSMMECDDEAIR

SEQ ID NO: 18645 - protein, 255 aa, Escherichia coli
MRHPLVMGNWKLNGSRHMVHELVSNLRKELAGVAGCAVAIAPPEMYIDMAKREAEGSHIMLGAQNVNLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 18646 - protein, 209 aa, Magnetospirillum magneticum
  unsure (1)..(209): unsure at all Xaa locations
MPEPGPXVLDLSPAYGAFLGGVVLGNSAQRDMLLKRAQPIGSVLLMVFFLSIGLLLDFKFIWKNLGTVLTLLAMVTLFKTALNVTALRLARQDWPSAFLAGVALAQXGEFSFLLAETGKAVKLISAQETKLVVAVTVLSLVLSPFWLFTMRRMHRVAXVHVHSFRDLVTRLYGDEARAFARNARRARVLVRRGSWRDDPNAGPGSGIST

SEQ ID NO: 18647 - protein, 342 aa, Gonyaulax polyedra
MPPTMGINGFGRIGRLVFRAALANPDIEVKAVNDPFMDVKYMVYQLKYDSVHKRFPGTISTKEVDGKEFLVVDGKDVQVFHEKDPASIPWGAAGANYICESTGVFTAQEKAELHIKGDAKKVIISAPPKDAVPIYVVGVNHEDYKTDRHSWSNASCTTNCLAPLTKVVHEKFGLLEGLMTTVHAMTATQLTVDGPSVAARTGVVAAAHPQNIIPSSTGAAKAVGKVIPAVNGKLTGMAFRVPTPDVSVVDLTCRIEKAAKYDDIVAAIKEAAAGPMSGVLDWTDEEVVSTDFVSCKSSSIFDVGAGISLNDNFVKLVSWYDNEWGYSNRLVDLAIYMAKKDG

SEQ ID NO: 18648 - protein, 306 aa, Musa acuminata
MAIPVIDFSKLDGKERAETMARIANGCEEWGFFQLVNHGIPVELLERVKKVSSECYKLREERFEGSKPVQLLDTLVKEGDGQRLDNVDWEDVFVLQDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 18649 - protein, 366 aa, Corynebacterium glutamicum
MTKITLSDLPLREELRGEHAYGAPQLNVDIRLNTNENPYPPSEALVADLVATVDKIATELNRYPERDVWNGDDAWLLYITKQTGVAVTRDNLWAANGSNEILQQLLQAFGGPGRTALGFQPSYSMHPILAKGTHTEFIAVSRGADFRIDMDVALEEIRAKQPDIVFVTTPNNPTGDVTSLDDVERIINVAPGIVIVDEAYAEFSPSPSATTLLEKYPTKLVVSRTMSKAFDFAGERLGYFVANPAFIDAVMLVPLPYHLSALSQAAAIVALRHSADTLGTVEKLSVDCVRVAARLEELGYAVVPSESNFVFFGDFSDQHAAWQAFLDRGVLIRDVGIAGHLRTTIGVPEENDAFLDAAAEIIKLNL

SEQ ID NO: 18650 - protein, 332 aa, Ralstonia metallidurans
MNSSSTPTARFVSTGTLPGPEEIRSLVEAAYENFREEAGGKLADYIPALAEADPSAFGICVANTRGHAFMVGEAAETFSIQSVSKPFVFALVCEALGAAEAATRLGVDATGLPFNSIMAMELRTDGTSNPLVNAGAIAATSLIPGFGADDRWHHVRQGLSRFAGRELACDEHVYESEAANNQRNAGLAHLLRGHGRLYCDPDEAVEVYTRQCALLVSARDLALMGATLAGGGVHPLTGEQVVSAATCQRVLAVMATAGLYERSGSWLYDVGLPGKSGVSGGILTIAPGKGAVATFSPPLDAAGNSVRGQLVMRFLSERLGLNLFISAPAAHL

SEQ ID NO: 18651 - protein, 349 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVEAFTATVGI

SEQ ID NO: 18652 - protein, 347 aa, Nostoc punctiforme
MFQTQLQHPTSKDEMQTTQTLKQIIAGAWITQGIYVVAQLGIADLLKDGSKSYDELATKTGVDARSLYRLLRALASVGIFAEGNSGYFELTPVAESLQSDRTDSLRGYAIKSGQAWEWQPWGHLLESIKTGKPVFKNIFGMERFDYLATDPSASKIYTQAISSISGEQDAAIAAGYDFSFIHNLVEVGGGNGTLIASILKSNLTMQGILFDLPHVVADAKPVIEDLELQDRCQLVGGNFFESVPTSGDAYLLRYIIHDWDDERAIAILKNCYQAMQPDGRLLLVEMVIPQGNEPFFGKLLDLQMLVNYGGRERTQAEYQVLLKTAGFSLTKIYPVAPPISIIEAIRL

SEQ ID NO: 18653 - protein, 470 aa, Zea mays
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGNEYVFVADSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVYFY

SEQ ID NO: 18654 - protein, 148 aa, Triticum aestivum
MAAAALRARLNNLVTSMFATGMLDENFHQLQSMEEDGTAARGYAADMINLFIKDTKRILNDIAGLLSQPVVDYDMVDVLVRQLKGSSYSVGAKKVNLSCMQFRRFNEPRSKERCLMALALAWSEFCEVRSKFEAMMQLEEQIATYGPK

SEQ ID NO: 18655 - protein, 185 aa, Triticum aestivum
  unsure (1)..(185): unsure at all Xaa locations
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 18656 - protein, 502 aa, Novosphingobium aromaticivorans
MMATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 18657 - protein, 330 aa, Clostridium thermocellum ATCC 27405
YNHSFELKEGLLGGCAIDATGEPFPKETLELCKSSDAVLLGAVGGPKWDNLPGDKRPEAGLLGIRGALGLYANLRPAVIYQALKGASPLRSDIVKDGIDIMVVRELTGGMYFGERGRVQTENMGQAAFDTEKYSEFEVERIARLAFETAMKRNKKLTSVDKANVLESSRLWREVVNRVASDYPEVELNHMYVDNAAMQLVRNPAQFDVIVTSNMFGDILSDEASMITGSIGMLPSASLGEGSLGLYEPIHGSAPDIAGQDKANPIATILSVAMMMKYSFGLEDAFRAIENAVVNVLGMGYRTADIASPDTPRENIVGTKEMGRLIISKLK

SEQ ID NO: 18658 - protein, 344 aa, Streptococcus mutans UA159
MKKIVTLAGDGIGPEIMAAGLEVFDAVAQKINFDYEIEAKAFGGAGIDASGHPLPDDTLAAAKTADAILLAAIGSPQYDKAPVRPEQGLLAIRKELNLFANIRPVRIFDALRHLSPLKAERIAGVDFVVVRELTGGIYFGQHTLTENSACDINEYSASEIRRIMRKAFAIARGRSKKVTSIDKQNVLATSKLWRQIAEEVAKEYSDVTLEHQLVDSAAMVMITNPACFDVVVTENLFGDILSDESSVLPGTLGVMPSASHSESGPSLYEPIHGSAPDIAGKGIANPISMILSVAMMLRDSFGETAGAEMIEHAVNKTLTQGILTRDLGGLANTKQMTAAIIANL

SEQ ID NO: 18659 - protein, 128 aa, Glycine max
  unsure (1)..(128): unsure at all Xaa locations
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 18660 - protein, 259 aa, Mycobacterium avium
MALAMITGASSGIGLELAELFAQRGYDLVVAAENDGIYPASDSLSRWGVDVRPVQVDLRTPEGVEKLYREATEGGRGLDAVALNAGVGGGGSFVEGELAHDLSIIDLNVRSTVHLAKLVLRNMTRRNTGKVLFTSSLASMAPGPFEAVYHASKSFVQSFAGALRDELRDTGITVTALMPGTIETNFFSRAGMDQTRAGQKPKDDPAEVARQGFEAMMRGHRKVVGGSLTTKTVGVALRFLPDSWKAAASRANSTPAGRR

SEQ ID NO: 18661 - protein, 301 aa, Shewanella oneidensis MR-1
MNKLTDFERYVIEEKGTERPFSGQYYQHDAKGVYLCKKCHTPLYRSEDKFNAHCGWPAFDDEIPGAVSRHIDADGRRTEIVCSQCGGHLGHVFEGEFLTPKNIRHCVNSVSMLFKAQDEAEDIAPKHAFATFGAGCFWCVEAIFKSLKGVLNVRSGYSGGEASDADYKSVCSGQTGHAEVVHIEFDPEQIAFTTLLQVLFESHDPTTLNRQGNDKGPQYRSVVFAHDATQVDEANAMIAKLTEARVFDAPIVTQVVAFESFYPAEAYHNDYFALHGEQPYCQIVVRPKVEKIRALFAELQV

SEQ ID NO: 18662 - protein, 180 aa, Zea mays
MASSMLSSAAVGTSPAQATMVAPFTGLKSSAAFPVTRKANNDITSITSNGGRVSCMQVWPPIGKKKFETLSYLPDLTDAELAKEVDYLLRNKWIPCVEFELEHGFVYREHGNSPGYCDGRYWTMWKLPLFGCTDSAQVLKEVEECKKEYPNAFIRIIGFDNTRQVQCISFVAYKPPSFTG

SEQ ID NO: 18663 - protein, 193 aa, Candidatus Blochmannia floridanus
MNKVLIIDNYDSFTWNLYQYFRKMGGIVDVKRHDSIDLMDFDHLSPDRLVISPGPGTTSNSGISFKAVNYFGNRIPIFGVCLGHQVIAQFFGAKLTYAQIVMHGKSSIIYHNDCGVFTGLVQSFRVIRYHSWVVDINTIPICLEVTAWSTYVDGKREIMGIRHRNLLIEGVQFHPESILTEYGYQILQNFMDY

SEQ ID NO: 18664 - protein, 819 aa, Haemophilus somnus 2336
MVNTLPLPFSYNRPENTKDSLKKSIVYKLIFLIARSPEEASQRDWLNATLYAIRDLVTEGWISTARQARKEETRRVYYLSMEFLMGRTLSNALISEGVYHLAKDALAELNVDLEDVLEKEVDPGLGNGGLGRLAACFMDSIATLAIPGMGYGIRYEYGMFQQYIEDGKQVEKPDAWLEKGYPWEFIRPSKRFNIRFGGHIYFEGKKCIWKNAEEITALAYDQMIPGYSNDSAATLRLWSANAGETFNLVSFNRGDYFHAIEEKSSSENVSRVLYPDDSTAAGRELRLRQEYFLVSASLQDIIKRHKRIYNTLDNLADKIAIHLNDTHPALAIPELMYILIDQEGYTWQKAWDMCCQIFSYTCHTLMSEALETWPVEMMAKILPRHLQIIFEINDYFLEYVRTSVTTDNDFIRRISLIEEGNIRKVRMGWLSVVGSHKVNGVAAIHSDLMVSSTFADFYRIYPERFTNVTNGITPRRWIAVANPDLSALFDKYIGTEWRKDLTQLETLKAHIQDPELKKAIPEIKRKNKQRLANYVKQELGIELNSNALFDVQVKRIHEYKRQILNVLHIVARYNEMIANPEKDWTPRVFILAGKAASAYTAAKQTINLINDVANIINNDDRLQGRLKVVFIPNYSVSLAQIIIPAADISEQISLAGTEASGTSNMKFALNGALTLGTLDGANVEILENVGKDNIFIFGNTVEQVEELRRNGYHPFDIYQSDEQLREVIDQINAGRFSPKEPTRYHDLLNSLRSYDYYQSFADFRSYVEMQKAVDEKYKNQEAWVESALQNIVNMSFFSSDRTILEYAEKIWKIEPLKLA

SEQ ID NO: 18665 - protein, 398 aa, Bacillus subtilis subsp. subtilis str. 168
MKFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 18666 - protein, 195 aa, Vibrio parahaemolyticus RIMD 2210633
MLLIIDNYDSFTYNLYQYFCELGAQVKVVRNDEIDIQGIEALNPTHLVISPGPCTPNEAGISLQAIEHFAGKLPILGVCLGHQAIAQVFGGEVVRARQVMHGKTSPIRHTGRSVFKNLNNPLTVTRYHSLVVKNGTLPDVFELTAWTELPDGSMDEIMGYQHKTLPIDAVQFHPESIKTEQGHELLANFLARRAI

SEQ ID NO: 18667 - protein, 171 aa, Frankia sp. PtI6
FFIHDPITKEQYSRDPRNIANKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARRPRKTVTFMPKP

SEQ ID NO: 18668 - protein, 471 aa, Ahnfeltiopsis complicata
TGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWSRANDMILHLHRAGNSTYSRQKIHGMNFRVICKWMRMAGVDHIHAGTVVGKLEGDPLMIKGFYDTLLLPYLKVNLPQGIFFEQDWASLRKVTPVASGGIHCGQMHQLLDYLGDDVVLQFGGGTIGHPDGIQAGATANRVALESIVIARNEGRDYVAEGPQILQDAAKTCGPLQTALDLWKDITFNYTSTDTADFVETPTANV

SEQ ID NO: 18669 - protein, 215 aa, Mycoplasma gallisepticum
MSDLLFSILPMLNDYDQNKLASYKQLGLNKIHYDVMDEFVNNKAFDERYVDNLKDLGYQINVHLMVNKVANHILVYAKTRCNQISFHVEPLANNKQLINKYLAYIKTNNKKAGLAFKFNTDVNDYLDQIKLVDYVTLMSVEPGAGGQAFNPLVYRNIAKLIKFNPKLEIEIDGGINFEKAIELKGLVSGFVSGSYFYQLSDQSKLEMLEKIRAFS

SEQ ID NO: 18670 - protein, 205 aa, Oryza sativa
RDKIAAGRPTSFTWLKKSYAHTWLGKFVLRQPEKLQEATFMLIQYSYALLTMLPCPLWFLSRWASATFLMVVFTWSIYNGATYYIDVFGVRFQKELEAMKAEVAQWQNSPEQIPLSPPFGARPDESSANQLTQQGVAPSASTGQIPSIKEVNREKDMMKDTSLSKDDANRPMSVENIPLLNDTQTSSSTGVQGRPVNNTQGRRID

SEQ ID NO: 18671 - protein, 284 aa, Zea mays
GWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDNLKVSGDVWFGSGITLKGKVTITAKSGVKLEIPDGAVLENKDVNGPEDL

SEQ ID NO: 18672 - protein, 394 aa, Zea mays subsp. mays
  unsure (1)..(394): unsure at all Xaa locations
LGAERRARLPPXDMGWPLVGGMWAYLRAXKSGKPDXFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 18673 - protein, 547 aa, Eremothecium gossypii
MTLVDKLLLRNIEYKGTAYDYFPKVYNVYLVAVVACISGMMFGFDISSMSSMQDFEPYKDYFKHPNELTQGGITASMAAGSLLGSILSPGISDAFGRRVSLHMCSSLWIIGAVLQTAAQNQAMLFVGRIVAGLGVGFGSSVAPVYTAEVSPPKIRGAVGGLFQLSVTVGILVMFLIGYGSVSLNSVASFRVAWSMQLVPGVVLLLATFLLPESPRWLANHGRWDETTLVVEKVGRSVNVSDEELRIHINEIRERVALDEMARDFTYADLFRRKTQRKIFIGMAAQMWQQLCGMNVMMYYIVHVFKMAGFSGNQNLVSSIVQYVLNVGMTIPSLFLVDRAGRRPVLIIGGVLMFTWLYAVAGILATYSVPRPNGVEGNTTVRIEIPPERSSAAKAVIVCSYLFVCSFAPTWGIGIWVYCAEIFNNIERARGSALCTSVNWAFNFALAMFVPTAFKNITWRTYIIFGTFSVALTIHAFLSFPETKGKTLEEIDEMWDAHIPAWRTASYKPELAQMAAPKLSSGSISDATGGLHEKKAAAGSPGASAGSS

SEQ ID NO: 18674 - protein, 471 aa, Amorpha fruticosa
MAATATDNKLSNLKSAVAGLNQISENEKKGFINLVSRYLSGEAQHVEWSKIQTPTDEVVVPYESLAPTPDGSSEVKSLLDKLVVLKLNGGLGTTMGCTGPKSVIEVRDGLTFLDLIVIQIENLNSKYGSNVPLLLMNSFNTHDDTQKIIEKYKNSNIQIHTFNQSQYPRLVVDDFLPLPSKGHTGKDGWYPPGHGDVFPSLSNSGKLDALLSQGKEYVFVANSDNLGAIVDLKILNHLVKNKNEYCMEVTPKTLADVKGGTLISYEGRVQLLEIAQVPDEHVSEFKSIEKFKIFNTNNLWVNLKAIKRLVEADALKTEIIPNPKEVDGVKVLQLETAAGAAIRFFDKAIGINVPRSRFLPVKATSDLLLVQSDLYTLEDGFVIRNKARANPENPTVELGPEFKKVSNFLSRFKSIPSIVELDSLKVAGDVWFGPGIILKGKVSIVAKPGVKLEIPDGAVIANKEINGPEDL

SEQ ID NO: 18675 - protein, 365 aa, Magnetococcus sp. MC-1
MDHDMSVQQWVRPEILAMAGYTPGEQPKPGEQVIKLNTNENPYGPPEAVKQAMHAAIHDNLRRYPSPDGYGVREAAARVLGHGLTPEQIILGNGSDDLLTMLLRTFIDPGQVVASMEPTYTLYEALVTIQGGCYRSVPWQPDGGLPLEGLVALQPKLIFVTRPNAPTGHVVPLEQVAALCQAVAQSAVVVLDEAYGDFAEDHGLPLLAAHPNLIITRSASKSLSLAGMRIGIGFMHADVALQMHKVRDSYNVDRVAQAALLAAYENWSDYAPLIARIKQQRQWTTTQLRKRGFEVKDSYGNFVLARVPQGGLDGLQWLESLKKRGILIRYFGSIPQLSEFLRITIGTEEEMALLMTAIDEIMKVA

SEQ ID NO: 18676 - protein, 329 aa, Oenococcus oeni MCW
MKRILVLATGGTISSTPQKNGLAPGMTIEQLSSFFDRADNEIEFIPTMDKDSTNIQPEDWLTIGRQILEHPKFDAYIITHGTDTMAYTASALSYLLNDLKKTIVLTGSQIPLSFEHTDAKRNIADALTVASKADFPGVYLVFDGQVIAGTRAVKVKSHSFDAFASINFPVVAKVENNQLEKKYNPTFNPAAFKTKFSLDTNVYLLKAFPGLSANFFDFVLKEKAGLIVESFGNGGLPDIGRDLVSGVKSLSNANLPVIITTQIMNEGQDISLYEVGQKVAAAGGITSGDMNTEAIVAKLMWAMAQTKDLSQIKKIIQTPIAHDLDRLLT

SEQ ID NO: 18677 - protein, 274 aa, Triticum aestivum
  unsure (1)..(274): unsure at all Xaa locations
MGCSLSXGLNALYDAATGGGDVWVNERRFRVLRQIGEGGFAFVYLVKEHDASSGAARDRHPSHVSDDGTYAMKKVLIQSREQLDLVKEEIRVSSLFNHPNLLPLLDHAIIAVKGDWSHEAYLLFPVHLDGTLFDNAAVMQSRKEFYSVVDVLRIFQQICEGLKHMHSLDPPYAHNDVKPGNVLVTRRKGQAPLATLMDFGSSRPARNQIRSRSEALRLQPSPPEHCSAPFRAPESWDCPSHADIDERTDIWSLGCTLYAIMYGVSPFVYALGES

SEQ ID NO: 18678 - protein, 505 aa, GIBBERELLA ZEAE PH-1
MSQDPATAPAKGGISTDADYHDAQTDVDLPRGWMYRRLHLFGKTLPWYASPRIQLGMVAFVCFMCPGMFNALGGLGGGGKTDPTLADNMNTALYGTFAVVGIFGGTFVNKLGIKACLSFGGVGYGLYAISLLVSVHKHVPGFNIFAGVWLGLCAAVLWTAQGTIMISYPHENQKGMYFAWFWGIFNMGAVVGSLIPLGENINIKENKTVSDGTYIGFIVLMFFGALLALTLCNAGDIIRKDGSRVILMKNPTWQSELWGLWETLRFEPFVVLLFPMFFSSNWFYVYQQNSVNGAYFNTRTKALNGLLYWLAQIIAAVIWGYLLDIERVKRTTRAKAAWAALFVLTFVIWGGGYAFEKTYTRETVSPDSGFVPGDWTDSGYAGPMFLYIFYGFYDAAWQATIYWFMGALSNSGRRSANYVGFYKGIQSVGACVVNHLDAKKISYRSEFISNWVLLSVSLVIAAPVILLKIKDHVSTEEDLQGTDETIADVLPSGHPEKNHERTSVA

SEQ ID NO: 18679 - protein, 221 aa, Arabidopsis thaliana
MLKKHLTTQLFQKKKKKKLHLVLDLDHTLLHSVLVSDLSKREKYLLEETDSRQDLWRRNVDGYEFIIKLRPFLHEFLLEANKLFTMHVYTMGSSSYAKQVLKLIDPDKVYFGKRVITREASPFNKSLDLLAADKRRVVIVDDTVHVWPFHKRNLLQITKYVYFKVDGTKWDSYAEAKKDESQSNGSLANVLKFLEDVHKRFEEDLGFKDLRLLIPCRQCCY

SEQ ID NO: 18680 - protein, 538 aa, Hordeum vulgare subsp. vulgare
MARSEQQGLQVLSALDAAKTQWYHFTAIVVAGMGFFTDAYDLFCISLVTKLLGRIYYTDLSKPDPGSLPPSVAAAVNGVAFCGTLAGQLFFGWLGDKMGRKSVYGMTLLLMVICSIGSGLSFAHTPKSVMATLCFFRFWLGFGIGGDYPLSATIMSEYANKKTRGAFIAAVFAMQGFGILAGGIVTLIISSAFRAGFHEPAYQDDRVASTGTEADFVWRIILMLGALPALLTYYWRMKMPETARYTALVAKNAKLAAADMSKVLQVELEDETEKMDEMVSRGANDFGLFSPQFARRHGLHLVGTATTWFLLDIAFYSQNLFQKDIFTSINWIPKARTMSALDEVFRISRAQTLIALCGTVPGYWFTVFLIDVVGRFAIQLMGFFMMTVFMLGLAVPYHHWTTPGNQIGFVVMYGFTFFFANFGPNATTFVVPAEIFPARLRSTCHGISAAAGKAGAMIGAFGFLYAAQDPHKPDAGYRPGIGVRNSLFVLAGVNLLGFMFTFLVPEANGKSLEEMSGEAQDNENEDQARTAAVQPSMA

SEQ ID NO: 18681 - protein, 165 aa, Triticum aestivum
ARRAWLWYRATRARPGRPASPRQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFADALAHPKVSHELRVIWIDFLSKCDKSCGMKVANRLNVTPGR

SEQ ID NO: 18682 - protein, 492 aa, Arabidopsis thaliana
MDPYKYRPASSYNSPFFTTNSGAPVWNNNSSMTVGPRGLILLEDYHLVEKLANFDRERIPERVVHARGASAKGFFEVTHDISNLTCADFLRAPGVQTPVIVRFSTVIHARGSPETLRDPRGFAVKFYTREGNFDLVGNNFPVFFIRDGMKFPDIVHALKPNPKSHIQENWRILDFFSHHPESLNMFTFLFDDIGIPQDYRHMDGSGVNTYMLINKAGKAHYVKFHWKPTCGVKSLLEEDAIRLGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 18683 - protein, 445 aa, Pseudomonas syringae pv. syringae B728a
MTLRQFAGLGALLSLALPGLALAADPVAEPVLNSGDTAWMLTSTALVLFMTIPGLALFYGGMVRSKNILSVMMQCFAITGLISILWVVYGYSIAFDTTGMEAGVVNFNSFFGGMGKAFLAGITPASITGPAALFPEAVFVTFQMTFAIITPALIVGAFAERMKFSAMLVFMGIWFTLVYAPIAHMVWGGVGGLLWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAVTPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 18684 - protein, 822 aa, Thermotoga maritima
MLEKLPENLKELESLAYNLWWSWSRPAQRLWRMIDSEKWEEHRNPVKILREVSKERLEELSKDEDFIALYELTLERFTDYMEREDTWFNVNYPEWDEKIVYMCMEYGLTKALPIYSGGLGILAGDHLKSASDLGLPLIAVGLLYKHGYFTQQIDSDGRQIEIFPEYDIEGLPMKPLRDEDGNQVIVEVPIDNDTVKARVFEVQVGRVKLYLLDTDFEENEDRFRKICDYLYNPEPDVRVSQEILLGIGGMKLLKTLKIKPGVIHLNEGHPAFSSLERIKSYMEEGYSFTEALEIVRQTTVFTTHTPVPAGHDRFPFDFVEKKLTKFFEGFESKELLMNLGKDEDGNFNMTYLALRTSSFINGVSKLHADVSRRMFKNVWKGVPVEEIPIEGITNGVHMGTWINREMRKLFDRYLGRVWREHTDLEGIWYGVDRIPDEELWEAHLNAKKRFIDYIRESIKRRNERLGINEPLPEISENVLIIGFARRFATYKRAVLLFSDLERLKRIVNNSERPVYIVYAGKAHPRDEGGKEFLRRIYEVSQMPDFKNKIIVLENYDIGMARLMVSGVDVWLNNPRRPMEASGTSGMKAAANGVLNASVYDGWWVEGYNGRNGWVIGDESVLPETEADDPKDAEALYELLENEIIPTYYENREKWIFMMKESIKAWLQNSAPPACCKEYTEKFYIKGLVNREWLERRENVEKIGAWKERILKNWENVSIERIVLEDSKSVEVTVKLGDLTPNDVIVELVAGRGEGMEDLEVWKVIHIRRYRKENESIRLHLHQWCLGHLGSPGWFYAVRVIPYHPRLPIKFLPEVPVVWKKVL

SEQ ID NO: 18685 - protein, 466 aa, Delisea pulchra
  unsure (1)..(466): unsure at all Xaa locations
YAEMGYWDPDYVIKETDVLALFRVTPQPGVDPVEASAAIAGESSTATWTVVWTDLLSACDLYRAKAYKVDAVPNTSDQYFAYISYDIDLFEEGSIANLTASIIGNVFGFKAVKALRLEDMRLPVAYLKTFQGPATGXXVERERMDKFGRPFLGATVKPKLGLSGKNYGRVVYEGLKGGLDFLKDDENINSQPFMRWKERYLYSMEGVNRSVAASGEVKGHYLNVTAATMEEIYERAEFAKQLGSIIIMVDLVIGYTAIQTMAIWSRRNDMILHLHRAGNSTYSRQKSHGMNFRVICKWMRMAGVDHIHAGTVVGKLEGDPLMIRGFYNTLLESKLDINLPQGIFFEQDWASLRKVTPVASGGIHCGEMHQLLDYLGIDVVLQFGGGTIGHPDGIQAGATANRVALESMVMARNEGRDFVTEGPQILLDAAKTCGPLQTALDLWKDITFNYTSTDTADFVETPTANV

SEQ ID NO: 18686 - protein, 497 aa, Zea mays
  unsure (1)..(497): unsure at all Xaa locations
CIRSSDLIDALDLRDSSFLQHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLXTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 18687 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 18688 - protein, 195 aa, Agrobacterium tumefaciens str. C58
MDVALALPLLVGLIAIALFFDFLNGLHDAANSIATIVSTRVLRPQYAVAWAAFFNFIAFLFFGLHVAETLGTGIIDPAIVSPQVIFAALIGAIVWNIVTWIFGIPSSSSHALIGGLVGAGFAKVGFNSIVWSGLLKTVGAIFMSPAIGFFLALLLVLAVSWLFVRQTPFAVDRTFRIMQFISASPYCPGHCADNR

SEQ ID NO: 18689 - protein, 374 aa, Solanum tuberosum
MRPLQPPPPAANSTSSAAASSMPPPSSAGQRSRPRRRTDLTLPLPQRDVALAVPLPLPPTSAPSSSSSSSSSPLPTPLHFSELERVNRIGSGTGGTVYKVLHRPTGRLYALKVIYGNHEDSVRLQMCREIEILRDVDNPNVVRCHDMFDHNGEIQVLLEFMDKGSLEGIHIPLEQPLSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRQGDWASLMCAICMSQPPEAPPTASREFREFIACCLQRDPARRWTAAQLLRHPFITQNSPGTHTGPATTSLSNQAHQLLPPPPHFSSSSSS

SEQ ID NO: 18690 - protein, 397 aa, Thermococcus sp. TK1
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 18691 - protein, 162 aa, Triticum aestivum
  unsure (1)..(162): unsure at all Xaa locations
MAPTVMASSATSVAPFQGLKSTAGLPVSRRSNGASLGSVSNGGRIRCMQVWPIXGIKKFETLSYLPPLXTEALLKQVDYLIRSKWVPCLELTXLGYLXXEXNASPGXTKGRXGTMWKLPMFGCTDATXVXXEVEEVKKXYXPYVRIXXFXICXKVXCVSSSL

SEQ ID NO: 18692 - protein, 512 aa, Porteresia coarctata
MFIESFRVESPHVRYGAAEIESEYRYDTTELVHESHDGASRWVVRPKSVQYHFRTSTTVPKLGVMLVGWGGNNGSTLTAGVIASREGISWATKDKVQQANYYGSLTQASTIRVGSYNGEEIYAPFKSLLPMVNPDDLVFGGWDISNMNLADAMTRAKVLDIDLQKQLRPYMESWCLSLASMIPTSSPLTRDPARTMSSREPRRSRWGRSSKDIREFKENNKMDKAVVLWTANTERYNNCLCLGLMTNGKPSASVDRNQAEISPSTLYCHCLASLEGVRSITGALKKKSWPGIDDLAIKKKLPDPGGLIQKRGKPKKKTGLVDFLMGAGIKPTSIVSYNHLGNNDGTNLSAPQTFRSKEISKSSVVDDMVSSNAILYEPGEHPDHVVVIKYVPYVGDSKRAMDEYTSEIFMGGKNTIVLHNTCEDSLLAAPIILDLVLLAELSTRIQLKGEGEEKFHSFHPVATILSYLTKAPLVPPGTPVVNALAKQRAMLENIMRACVGLAPENNMILEYK

SEQ ID NO: 18693 - protein, 642 aa, Methanosarcina barkeri
MKRKEFRKLISVEKAREIINSLQVLPRQESLALENAYGEILAEDIVTEINVPPFPRAIMDGYAVRAEDTYACSETEPVKLKLLGNVQAGSNEKFKVSSGESVEISTGAPIPEGANAVVMVEYSSEGDSTVSIYSPVTVGENIMKAGSDIRKGERVLRAGRKLGIREIGVLASVGKKDVPVSKLQVGIISTGDELVHPGEKLTPGKIYDANSYTLYAGIHECGAFPLLYGIVEDNEAAMKEALETAVSECDLILTSGSTSSGSGDVMYRLIDEIGETLAHGISIKPGKPVVIGIIKGVPIIGLPGNPTSALMIFNEFVAPLLRKALGEDKVLKKTEKGIMGTVFRSEGRQQFLPVGLIRERVYPADKGSGAITSLSGADGFIEIPSSTEFIEAGTPVEVTLFGKVEKPDLLIAGGFCPGFDLLEDLSGLRLRTLYTSSSGGFSAIAANTADIAGVNMPSQDSRGPDGILYNIPTIENMGLLDIALVKGYRREVGLLVRQDSPVSGLSDLPGKQLINRNRGSGTRALLDLKITEFVAGKGISKKEFTDSIPGYTSGAKSEVAVCEAVVSGKAEVGVGIRNCTKKNGLKFVKFAEEEYDFLIKKEILETPEVRRFLEVLNSPEFASKLPDGLHVYERTGEIIFFE

SEQ ID NO: 18694 - protein, 170 aa, Zea mays; identical to SEQ ID NO: 3644

SEQ ID NO: 18695 - protein, 396 aa, Oryza sativa (japonica cultivar-group); identical to SEQ ID NO: 16371

SEQ ID NO: 18696 - protein, 507 aa, Arabidopsis thaliana
MAVVVSNANAPAFEAKMTVYVFICVMIAAVGGLIFGYDIGISGGVSAMDDFLKEFFPAVWERKKHVHENNYCKYDNQFLQLFTSSLYLAALVASFVASATCSKLGRRPTMQFASIFFLIGVGLTAGAVNLVMLIIGRLFLGFGVGFGNQAVPLFLSEIAPAQLRGGLNIVFQLMVTIGILIANIVNYFTATVHPYGWRIALGGAGIPAVILLFGSLLIIETPTSLIERNKNEEGKEALRKIRGVDDINDEYESIVHACDIASQVKDPYRKLLKPASRPPFIIGMLLQLFQQFTGINAIMFYAPVLFQTVGFGSDAALLSAVITGSINVLATFVGIYLVDRTGRRFLLLQSSVHMLICQLIIGIILAKDLGVTGTLGRPQALVVVIFVCVYVMGFAWSWGPLGWLIPSETFPLETRSAGFAVAVSCNMFFTFVIAQAFLSMLCGMRSGIFFFFSGWIIVMGLFAFFFIPETKGIAIDDMRESVWKPHWFWKRYMLPEDDHHDIEKRNA

SEQ ID NO: 18697 - protein, 323 aa, Methanopyrus kandleri AV19
MNVLEVLVVVVPSLYMGWTIGADDAGAAMGSAVGAGVRTMRQAVTLIAVFTTMGAVLEGHKVVKTLGKGVVQAHLDPIAAGATVLVAAAWYHLAVMLGVPVSTTQATVGSIAGVGCALGLPVNWSKFGQIAVGWFLSPILAMIPAYFVSRRLRAVLEKGKWPLAEIERKIGWLLTISGCYVAYTIGANNAANAVAPIVMTGLLDVRSAAIVGGIMIAVGALTAGSKVIETVGRKITRLDPVTAFSAELSAAIVTHGASELGIPISINETTAGAVIGVGLSRGELNTHTLKKIFTTWIASPVGSFVMSYALMRLYLSVRGAAVP

SEQ ID NO: 18698 - protein, 479 aa, Myriogramme sp.2
  unsure (1)..(479): unsure at all Xaa locations
QVKNDRYESGVIPYAKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDEXXXXXXXXXXXXXXXXXXXXXXXXXXXXXXXXXXXXXXXXXXXEDMYERAXFAKDLGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVKLEQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 18699 - protein, 101 aa, Hordeum vulgare subsp. vulgare
PKKTKKIKGPVSRDDSFKKKVNRMEQRDKLGLSPRGKGNTREYGEAGTAMDKVQLEKKKQDDALDDLSGVLGQLQGMAVDMGSELDRQNKALDDMHGDVEE

SEQ ID NO: 18700 - protein, 326 aa, Pseudomonas fluorescens PfO-1
MQLGIIGLGRMGGNIARRLMLNGHTTVVYDRNTAFVDTLAAEGSTGVADLPALVAGLAKPRAVWVMLPAGAPTEDTIETLSHLLEAGDTIIDGGNTNYKDDIRRAKTLAEKGLHYIDVGTSGGVWGLERGYCMMIGGDAETVKRLDPLFAALAPGMGDIPRTKDRKSDDHRAEHGYIHAGPAGAGHFVKMIHNGIEYGMMAAFAEGFDILKTKSSELLPEDQRFDLNVADIAEVWRRGSVVSSWLLDLTADALAVDPKLDGFSGSVADSGEGQWTIEAAMEQKVPVPVLSNSLFSRYRSRGQGTFGDKILSAQRFGFGGHVETPKK

SEQ ID NO: 18701 - protein, 217 aa, Lactobacillus plantarum WCFS1
MIKVAPSILSADFANLQRDVQMAENAGADALHIDVMDGQFVPNLSFGMSTVADLRPVTSLMLDCHLMIMDPERFVGQFAKAGADLIGVHVESTRHIYHALQLIKDAGVKAEVVVNPGTPLSMISELLPLVDQVLIMTVNPGFGGQHFLDQMVAKIAALNELKQQHGYRFEIEVDGGINDQTVKACYDAGATVAVAGSYVYDSADPAQRIQDLKVATN

SEQ ID NO: 18702 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGGAKKVIISAPSADAPMFVCGVNLDAYDSKYKVISNASCTTNCLAPLAKVIHDKFGIVQGLMTTVHATTATQKTVDGPSNKDWRGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 18703 - protein, 365 aa, Helicobacter pylori J99
MHNACNCNSQRVPFKGFAIDGKDGKFHEWEHSRHAMGEYDVVIDTHFSGICHTDIHFAHSDWLPGIYPMVPGHEIAGVVSAVGSKVTKFKVGDHAGVGCMVNSCGECHTCKHEHQEQWCENNKTIYTYSWEDSFHNNEPTYGGYSNNIVVSENFVISIPKEAPLDKAAPLLCAGITVYSPLKFSKVTKGSKVGIAGFGGLGHMALKYAVAMGAQVSVFARNDKKKQMAQKLGATNFYTSVGECKEKFDLIVSSIPTQYDLLAYTKLLKYGGEVAIVGIPPKDPQRNLDFGDLVLFSGNHKVYGSWIGGVKETQEMMDFSVKHGIYPEIELVTGQEIDATWDKLLNGQGNFRYVIDMKKSMENFKK

SEQ ID NO: 18704 - protein, 360 aa, GIBBERELLA ZEAE PH-1
MSVPDKFQGFQSPSAEHWTDFQKNSFEPRPFGEYDVDIKVECCGVCASDRHTISGDWGACPYPLAVGHEVVGKVLRVGDKVTLAKVGDRVGAGAQVWSCMDCRQCKNDNETYCKDQIDAYGADYLDTGFKTQGGYSSHSRVHEYWVYPIPEALSSTQAAPMLCAGITVYSPLKRLGAGPGKKVGIVGIGGLGHYGVIFAKALGAEVWAISRSRAKEEDARKMGADGFLATGEKNWTEGHKMTFDIIINTATSFDGFALSEYLSLLDIHGHWNSVGLPGGDGIEIRNQDFITNGCYIGTSHLGSRREMLEMLQLAADKGLKSWIEEIPISTKGLQQAMQALEKSSVRYRSCMTNYDEAFGA

SEQ ID NO: 18705 - protein, 214 aa, Neurospora crassa
MANDEYDIPLPVVLIGDSGVGKSNLLSRFTRNEFNLDSKSTIGVEFATRSIQVDSKTIKAQIWDTAGQERYRAITSAYYRGAVGALLVYDISKGVTFENVNRWLKELRDHADQNIVIMLVGNKSDLRHLRAVPTEDAKKFAEENHLSFIETSALDATNVELAFQNILTEIYKIVSTKNFDNGPSGSNEGHQNLSGQSISLSQTANDPQAKSGCC

SEQ ID NO: 18706 - protein, 468 aa, Desmarestia sp. Seto Inland Seas
IPYAKMGYWDADYNVKDTDILALFGITPQPGVDPVEAAAAVAGESSTATWTVVWTDLLTACDIYRAKAYRVDPVPGTSDQFLAYVAYECDLFEEGSLANLTASIIGNVLGFKGVKALRLEDMRIPLAYLKTFQGPATSVIVERERLDKFGRPLLGATVKPKLGLSGKNYGRVVYEGLRGGLYFLKDDENINSQPFMRWKERYLYCMEGVNRAAAATGEVKGSYLNVTAATIEQMYERAEYAHAIGSVIVMVDLVMGYTAIQTMAIWARKAEMILHLHRAGNSTYARQKNHGINLRVICKWMRMCGVDHIHAGTVVGKLEGDPLMVRGFYNTLLLTQLKVNLAEGLFFDMDWASLRKCVPVASGGIHCGQMHQLLYYLGDDVVLQFGGGTSGHSGGIQGGATANRVALEAVVLARNEGRDYVGEGPEILRNAASTFGPLKAALDLWKDITFDYTSTDTPHFVEVATESN

SEQ ID NO: 18707 - protein, 339 aa, Glycine max; identical to SEQ ID NO: 5440

SEQ ID NO: 18708 - protein, 426 aa, Mycobacterium tuberculosis H37Rv
MRSVEEQQARISAAAVAPRPIRVAIAEAQGLMCAEEVVTERPMPGFDQAAIDGYAVRSVDVAGVGDTGGVQVFADHGDLDGRDVLTLPVMGTIEAGARTLSRLQPRQAVRVQTGAPLPTLADAVLPLRWTDGGMSRVRVLRGAPSGAYVRRAGDDVQPGDVAVRAGTIIGAAQVGLLAAVGRERVLVHPRPRLSVMAVGGELVDISRTPGNGQVYDVNSYALAAAGRDACAEVNRVGIVSNDPTELGEIVEGQLNRAEVVVIAGGVGGAAAEAVRSVLSELGEMEVVRVAMHPGSVQGFGQLGRDGVPTFLLPANPVSALVVFEVMVRPLIRLSLGKRHPMRRIVSARTLSPITSVAGRKGYLRGQLMRDQDSGEYLVQALGGAPGASSHLLATLAEANCLVVVPTGAEQIRTGEIVDVAFLAQHG

SEQ ID NO: 18709 - protein, 515 aa, Oryza sativa; identical to SEQ ID NO: 13832

SEQ ID NO: 18710 - protein, 186 aa, Zea mays; identical to SEQ ID NO: 12146

SEQ ID NO: 18711 - protein, 474 aa, SYNECHOCOCCUS SP. WH 8102
MAQFEKLTAPSQGTPIRFENGQPVVADNPIIPFIRGDGTGVDIWPATQKVLDAAVAKAYGGVKTIEWFKVYAGDEACDLYGTYQYLPEDTLEAIRTYGVAIKGPLTTPVGGGIRSLNVALRQIFDLYSCVRPCRYYEGTPSPHKRPQDLDVIVYRENTEDIYMGVEWEADDAVGQELRKHLNEVVIPANGKLGKRQIPEGSGIGIKPVSKHGSQRHIRKAIQHALRLEGNKRHVTLVHKGNIMKFTEGAFRDWGYELATTEFRDVCITERESWILGNLEKDSGLSVQANARMIEPGYDSLTPEKKADIDAEVQAVIDAIGSSHGGGKWRSMVLVDDRIADSIFQQIQTRPQEYSILATLNLNGDYISDAAAAMVGGLGMAPGANIGETAAIFEATHGTAPKHAGLDRINPGSVILSGVMMLEFLGWQEAADLVTKGLSAAITDKQITYDLARLMEPQVDPVSCSGFAEAIIQRF

SEQ ID NO: 18712 - protein, 251 aa, Bacillus cereus ATCC 14579
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 18713 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFRGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 18714 - protein, 336 aa, Desulfovibrio vulgaris subsp. vulgaris (strain Hildenborough)
MLEIPLLLVVIIVVALIFDFTNGAHDCANAIATVVSTKVISPKVAVIMAAGLNLFGAFLGEEVAHTLGSGIVNTDMVMGCQALVLAALIGAIAWNLITWYFGIPSSSSHALIGGLMGAAVAYSGFGTLNGPSIAKKILLPLVLSPLAGFAVGFLFMSLLALGLWKVSRQRVSSTFHRLQILSAAFMATSHGLNDAQKTMGVITLALFIFHEIDTIHVPFWVKFICASAMAAGTALGGWKIVKTMGHRIFKLEPVHGFAAETSAALVITGASAFGAPISTTHTITACIFGVGSTKRLSAVRWGIAGNLVVAWVLTIPASALIAALSFWLLDLMGFVQ

SEQ ID NO: 18715 - protein, 346 aa, Vibrio vulnificus CMCP6
MEKLARKSVQKLTPYLSARRIGGTGDVWLNANESPFDNEYRTNFARLNRYSDCQPKALIAAYAAYAGVKPEQTLTSRGADEGIELLIRAFCETNEDAILYCPPTYGMYSVSAETIGVERKTVPLTEDWQLDLSGIEANLDKVKLVFVCSPNNPTGNLVKREDIIALLEMTKDRAIVVMDEAYIDFCPEASTVDLLAQYSNLAILRTLSKAFALAGLRCGFTLANEELINVLLKVIAPYPVPVPVAEIATQALSEAGLARAKFQVLDLNANRAYLQVGLSMIAGLEVFEGWGNYLLVKFPNGDELFKAAWESGIILRNSPIKDCVRISVGSRDECEKTLGFIRNYYS

SEQ ID NO: 18716 - protein, 457 aa, Pedinella sp. squamata
TYTVKATDVLALFRITPQPGVDPVEATAAVAGESSTATWTVVWTDLLTACDIYRAKAYRVDPVPNSPDQFFGYIAYEIDLFEEGSLANLTASIIGNVFGFKAVKALRLEDMRIPFAYLKTFQGPATGVVVERERLNCFGRPLLGATVKPKLGLSGRNYGRVVFEGLKGGLDFLKDDENINSQPFMRWRERFLYVQEGITRASAATGEVKGSYLNITAGTMEDVYERAEYAKDLGTVIVMIDLVMGYTAIQSSAVWARKNDMILHLHRAGNSTYARQKNHGINFRVICKWMRMAGVDHIHAGTVVGKLEGDPLMVKGFYHTLLDVTSDINLPQGIFFAQDWASLRKCLPVASGGIHCGQLHQLVHYLGDDVVLQFGGGTIGHPDGIQAGATANRVALEAMIMARNEGRDYVQEGPAILQAAARMCGPLQTALDLWKGISFNYTSTDTPDFAVTPTANV

SEQ ID NO: 18717 - protein, 479 aa, Cryptopleura ruprechtiana
RLKNERYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLLSHLEVDLPQGIFFKQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTPDFVETPTANV

SEQ ID NO: 18718 - protein, 332 aa, Gonyaulax polyedra
MAGPQLDDFTLVKVLGKGSYGKVMLVRGAQDNRLYAMKMLRKENVIKRNQVEHTKTERSVLETVSHPFIVTLHYAFQTPKKLYMVMEYCPGGELFFHLSRAGRFSEGRTRFYVAETSSAVAYLHQLNVIYRDLKPENLLIDGEGHAKITDFGLRKEGIQDNHSAMTMCGTPEYLAPEILDKKGHGKAVDWYSVGALTYEMLTGLPPFYTKDLQKLFDRIRRGELTYPDYVSVLAKEFLRALLQRNPDARLAGGVPGGDEVKGHEFFGGLDWVALEKRAIPPPFKPTFGGQKEDDVVKYFEKDFVGQPVVNSEVGEGGRDLGHLEASTLTGKR

SEQ ID NO: 18719 - protein, 416 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKGQRSCSCK

SEQ ID NO: 18720 - protein, 429 aa, Pyrobaculum aerophilum str. IM2
MPDGLAVWRVLRGAGVKLVKFIVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 18721 - protein, 397 aa, Zea mays; identical to SEQ ID NO: 14492

SEQ ID NO: 18722 - protein, 797 aa, Salmonella typhimurium LT2
MSQPTFNKDQFQAALTRQWQRFGLLSASDMTPRQWWQAVSGALAELLSAQPVAQPTKGQRHVNYISMEFLIGRLTGNNLLNLGWYQDVSDVLKAHDINLTDLLEEEVDPALGNGGLGRLAACFLDSMATVGQSATGYGLNYQYGLFRQSFVEGKQMEAPDDWHRGSYPWFRHNEALDVQVGIGGKVTKEGRWEPGFVITGQAWDLPVLGYRNGVAQPLRLWQATHAHPFDLTKFNDGAFLRAEQQGIDAEKLTKVLYPNDNHTAGKKLRLMQQYFQCACSVADILRRHHLAGRKLHELADYEVIQLNDTHPTIAIPELLRVLIDEHQLSWDDAWAITSKTFAYTNHTLMPEALECWDEKLVKALLPRHMQIIKQINDRFKTLVDNTWPGDKQVWAKLAVVHDRQVRMANMCVVSGFAVNGVAALHSDLVVKDLFPEYHQLWPNKFHNVTNGITPRRWIKQCNPQLAALLDKTLKKEWANDLDQLINLEKYADDAKFRQQYRDIKRANKERLVKFIKARTGIEISSNAIFDIQIKRLHEYKRQHLNLLHILALYKEIRENPQADRVPRVFLFGAKAAPGYYLAKNIIFAINKVAEAINNDPAVGDKLKVVFLPDYCVSAAEMLIPAADISEQISTAGKEASGTGNMKLALNGALTVGTLDGANVEIAEKVGEENIFIFGHTVEEVKALKAKGYDPVKWRKKDKVLDAVLKELESGQYSDGDKHAFDQMLHSLGKQGGDPYLVMADFAAYVEAQKQVDALYRDQEAWTRAAILNTARCGMFSSDRSIRDYQARIWQAKR

SEQ ID NO: 18723 - protein, 320 aa, Clostridium thermocellum
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDPQDGCGRHDRVVDSGSK

SEQ ID NO: 18724 - protein, 351 aa, Saccharomyces cerevisiae
MPSQVIPEKQKAIVFYETDGKLEYKDVTVPEPKPNEILVHVKYSGVCHSDLHAWHGDWPFQLKFPLIGGHEGAGVVVKLGSNVKGWKVGDFAGIKWLNGTCMSCEYCEVGNESQCPYLDGTGFTHDGTFQEYATADAVQAAHIPPNVNLAEVAPILCAGITVYKALKRANVIPGQWVTISGACGGLGSLAIQYALAMGYRVIGIDGGNAKRKLFEQLGGEIFIDFTEEKDIVGAIIKATNGGSHGVINVSVSEAAIEASTRYCRPNGTVVLVGMPAHAYCNSDVFNQVVKSISIVGSCVGNRADTREALDFFARGLIKSPIHLAGLSDVPEIFAKMEKGEIVGRYVVETSK

SEQ ID NO: 18725 - protein, 213 aa, Shigella flexneri 2a str. 301
MTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 18726 - protein, 290 aa, Glycine max
MAKPRYSRLPPRKSSSSSTLILTLFLVFTFLVLILLALGILSIPSSSRGNLPKPNDLASIARNTIHTSDDDDVRGEQWVEVVSWEPRAFVYHNFLTKEECEYLIDIAKPNMHKSSVVDSETGKSKDSRVRTSSGTFLARGRDKIVRDIEKRIAHYSFIPVEHGEGLQVLHYEVGQKYEPHYDYFLDDFNTKNGGQRIATVLMYLTDVEEGGETVFPAAKGNFSSVPWWNELSECGKKGLSIKPKRGDALLFWSMKPDASLDPSSLHGGCPVIKGNKWSSTKWMRVSEYNA

SEQ ID NO: 18727 - protein, 154 aa, Triticum aestivum
  unsure (1)..(154): unsure at all Xaa locations
GVPCRHQRAASRXWXMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 18728 - protein, 412 aa, Escherichia coli K12
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 18729 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLDHQGRTLDTQFQVFKEITVAQARLDDPAKAPAEIARVLGAARSLSRPVYLEIPRNMVNAEVEPVGDDPAWPVDRDALAACADEVLAAMRSATSPVLMVCVRSAATGLEAKVADVAHGLGVPVVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDRGLMAPGYYAGMGFGVPAGIGAQCVSGGKRILTVVGDGAFQMTGWELGNCRRLGIDPIVILFNNASWEIVRTFQPESAFNDLDDWRFAEMAAGMGGDGVRVRTRAELKAALDKAFATRGRFQLIEAMIPRGVLSDTLARFVQGQKRLHAAPRE

SEQ ID NO: 18730 - protein, 375 aa, Limonium latifolium
MANHSSAAAMVVDETSEARNNARLKIIELANLISVPMSLTAIVRLKVPEAIWSNGSNTPVSAAEILSRLPDAPATADAENLQRLLRVLTSFGVFSEHLDTTSSSSSSTSERRYCLTEVGQTLVSFDESCPSHGAYVLQHHQETLLKAWPFLHTAILDASTEPFARVNGEPAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 18731 - protein, 280 aa, Glycine max; identical to SEQ ID NO: 3932

SEQ ID NO: 18732 - protein, 821 aa, GIBBERELLA ZEAE PH-1
MNCNELQEHARADCFLVKKPRALQWFYKGELQKEKEEERQAGRFELFLDLLYVAIVANFSDELAEHPDGAHLAKYILIFAPAWHIWADLREIMNSYYTDDILQRLVILWVMALLVLYANNANDADVDIAAMRTTVGAYLVARFTTLTVFLVTSFAAYQHRAQARIMAGFMFVGLIITIPLFLEDISIRAKAAIVAVGIFYQEATWALTLSPWIKGKLNLTYSTAVDIAHEIDRMGAFFIIILGEFVYSIIVGNKTGIGLTSGYAKAVCTLIIAFVLNWIYSSGDGSVQAVHPIRRSAWTAFGFFLLHLPLAASFLIGGHVAAASTAIEEFEDGQRWLVGGGLGVGMFCLWVYGMLYRVEGECTLLMGQTLRIGMRLVIAIVLIIIPESHNHLNAEDFMLVVMGLFAFLLIWETLGGGCAICNDSFCTNGVTYASLSRGATRVLIAPPAPDPKVVTSAGGVNLLILTPTYYIINYQLLIPRPTTNISHNTIVAFHKQIPSSSHTLINPTSMADFAPPAGPPPPKAPDVPAGWAVRWNDQYKEWFYVNVYTKQSQWEKPTAPVFPSDDGAPAGPPPGYEPGNTPVVTDTKKNPYEDVTANAGGSSQDEDAKLAARLQAEEDARARSGHGGPDVPAGYGGSNNPFPQSNSPYPQQQQGGSNYPSELPPRDRGAKSGGFLGKLIGKGKQMADKRQQQQGQGGYGGGYPQQQYYPQQSQGGYPGQGPPMGYGAQPHYGGGGYGAPGGYGGYGGGPGYGQPGGGFGGGGMGGGRKPGGGGMGMAGGAALGAGAGLLGGAMLMNSFDNDEQEAYQDGFEDGADFDGGD

SEQ ID NO: 18733 - protein, 187 aa, Cyanidioschyzon merolae
MILLIDNYDSFTFNLVHSLSHSDLILCRNDELDLSSLSLLPIRSIIISPGPGHPRDLSHAIPFLSHYLPRVPILGVCLGHQLLAQLFHWHVKPAPSPLHGKVSLIFHQHDFLFQDVPNPFQATRYHSLLAYPTPHSPLLAIAHSSDGLVMAFKHSSFPLYGVQFHPESILTTHGLQIFRNFLSLSSP

SEQ ID NO: 18734 - protein, 362 aa, Corynebacterium glutamicum
MIAAGVKDVAQCVDVMEETLVLLAQGDYKMAGLNSNSHGAMITFPENPEFEGMPKDGPDRRFMAMPAYLGGRFKNTGVKWYGSNAENKASGLPRSIHTFVLNDTVTGAPKAIMSANLLSAYRTGAVPGVGVKHLAVADATTLAVVGPGVMAKTITEACIAERPGITTIKIKGRSERGINAFATWALEKFPEIEVVAVGSEEDVVKDADIVIAATTTDAAGSSAFPYFKKEWLKPGALLLLPAAGRFDDAYLLDDARLVVDYMGLYEAWAEEYGPQAYQLLGIPGTHWYDLALQGKLDLAKISQIGDICSGKLPGRTNDEEIILYSVGGMPVEDVAWATQVYENALEKGVGTTLNLWESPALA

SEQ ID NO: 18735 - protein, 338 aa, Sordaria macrospora
MVVKVGINGFGRIGRIVFRNAIEHDDIQIVAVNDPFIEPKYGEYMLRYDSTHGNFKGTIAVEGSDLVVNGKKVKFYTERDPSAIPWSETGADYIVESTGVFTTTEKASAHLKGGAKKVIISAPSADAPMYVMGVNNESYDGSANVISNASCTTNCLAPLAKVIHDNFTIVEGLMTTVHSYTATQKTVDGPSSKDWRGGRTAAQNIIPSSTGAAKAVGKVIPDLNGKLTGMSMRVPTANVSVVDLTVRIEKGASYDEIKEVVKKASEGPLAGILAYTEDEVVSSDMNGNPASSIFDAKAGISLNKNFVKLVSWYDNEWGYSRRVLDLISYVAKVDASKA

SEQ ID NO: 18736 - protein, 485 aa, Streptomyces avermitilis MA-4680
MSKRVLTTESGAPVADNQNSATAGVGGPLLLQDQHLLEKLARFNRERIPERVVHARGSGAYGHFEVTDDVTGFTYADFLNTVGKRTEVFLRFSTVADSLGGADAVRDPRGFAVKFYTEEGNYDLVGNNTPVFFIKDPLKFPDFIHSQKRDPFTGKQEPDNVWDFWAHSPEATHQVTWLMGDRGIPASYRHMNGYGSHTYQWTNAEGEAFFVKYHFKTNQGIRSLSAEQAQEIAGTDPNSHQTDLLQAIERGVRPSWTLYVQIMPAAEAAEYRFNPFDLTKVWPHTDYPLQRVGRLVLDRNPDNVFAEVEQAAFSPNNFVPGIGPSPDKMLQGRLFAYADAHRYRLGVNHTQLAVNAPRATVVSNYGRDGLMASPAQGRAAKNYEPNSYDGPAETGRPLSAPLAVTGHTGTHEAPPHTKDDHFFQAGELYRLMSAEERSRLVANIAGGLSQVSRDDVIEKNLTHFHAADPEYGTRVEEAVRALRED

SEQ ID NO: 18737 - protein, 490 aa, Synechocystis sp. WH 8501
MVTATRPENKVKIGPTQLLINNKWVESASGKRFETINPSTGEVICDVAEADAADVDKAVIAARNAFNQGDWPKLSATQRGQLLYKLADLIEANIEELARLETLDNGKPYQDSLNADLQLVIACYRYYAGWADKIQGKTIPINGPYFCYTRHEPVGVVGQIIPWNFPLLMQAWKLAPALAAGNTVVMKTAEQTPLSALRLGELILEAGFPPGVVNLLSGYGPTAGQAIARHHDIDKVAFTGSTEVGHLIMEAAAQTNLKRVTLELGGKSPNIVFADANLEQAIEGAHFGLFFNQGQCCCAGSRLFVEEKCYDEFVAKSVERAKQRIVGDPFDDNTAQGSQVDRTQFDKVMEYIESGQREGAKLLCGGGRVGDRGYFIEPTVFAEVKDNMKIAQEEIFGPVMSIIKFKDMDEVIQRTNDTVYGLAAAVWTQDISKGHAIANALRAGTVWVNCYDVFDAAAPFGGFKQSGMGRELGEYGLQQYTEIKTVTVKL

SEQ ID NO: 18738 - protein, 328 aa, Petunia integrifolia subsp. inflata
MAVNGASSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 18739 - protein, 81 aa, Zea mays
CLYVALQMSVQDANMSSDTDMSKVFEDRTFVSSILNSLPGVDPNDPSIKDLLASLHSQGEEEKKEDKLDKTEDEKNCFKLE

SEQ ID NO: 18740 - protein, 593 aa, Zea mays; identical to SEQ ID NO: 11982

SEQ ID NO: 18741 - protein, 336 aa, ASPERGILLUS NIDULANS FGSC A4
MSTSKSRWADEDPETEALIAQRKREKEEKRRAKAEKQRLEEQAKAQAAAERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDEVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLGAESYGPEVDMWSVGCIFGELLTKEPLLQGKNEVDQVSKVCTVLFFFFSFKI

SEQ ID NO: 18742 - protein, 306 aa, Streptococcus mutans UA159
MANEFINFEKISRKTWQHLHQESQPPLNENELNSIKSLNDRISIKDVTDIYLPLISLIQIYKKSQENLSFSKSIFLQKNISNRPFIIGVSGSVAVGKSTTSRLLQLLLARTFKDSSVELMTTDGFLYPNAVLSSRHMLNKKGFPESYDMERLLDFLDTIKNGQSAEIPVYSHEIYDIVPNKSQIIEVPDFLIIEGINVFQNPQNNRLYMSDFFDFSIYIDADSDYIENWYLERFATLLDLAKNDKQNYYNRFLKLGEKGALDFARDIWKDINLVNLEKYIEPTRSRAELILHKTKNHKIDEIYLKK

SEQ ID NO: 18743 - protein, 526 aa, Citrullus lanatus
MASSMAAVGVLRLPTTSASSSSSSNGGSNRARRHSLRSLSFGASHISGDKIDFRASALGSRRVSGGRAVPSIVSPKAVSDSKNTQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKTMKVDTTILGLDDARGKEMPFIASMGIYVISKDVMLSLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGEDVKIVNGDNVQEAARETDGYFIKSGIVTVIKDALIPSGTVI

SEQ ID NO: 18744 - protein, 511 aa, Shigella flexneri 2a str. 301
MRKWANSARKAMLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEANFLDWGWRIPFFIALPLGIIGLYLRHALEETPAFQQHVDKLEQGDREGLQDGPKVSFKEIATKYWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFMGVMASTLPAMFPTHIRYSALAAAFNISVLVAGLTPTLAAWLVESSQNLMMPAYYLMVVAVIGLITGVTMKETANRPLKGATPAASDIQEAKEILVEHYDNIEQKIDNIDHEIADLQAKRTRLVQQHPRIDE

SEQ ID NO: 18745 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWQDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 18746 - protein, 394 aa, Oryza sativa
  unsure (1)..(394): unsure at all Xaa locations
FFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPXAADYVWRIVLMIGAFPAFGEPFYWRNERCRKTARYTAIIDGNAKQGGEXDMQKVLSIEIEAEQEKLAKFNAANNYPLLSMEFARRHGLHLIGTTTTWFLLDIAFYSQNLTQKDILPAMGLISGAAEVNALTEMFQISKASFLVALLGTFPGYWVTVALIDKMGRYMIQLIGFFMMSMFMLAMGILYDYLKTHHFLFGLLYALTFFFANLGPN

SEQ ID NO: 18747 - protein, 342 aa, Methanosarcina acetivorans C2A
MDLLVIAIILAGLYMAWNIGANDLANAMGTSVGTGALTIKQVIVIAAVFEFLGAVFFGKRVTSTIAKGIVPIDMISSIHPDIVVLGMLAAILAASFWVTLATFYNLPVSTSHSIVGSVLGFGLVAAYNGSISFSDIHWGELTRIIASWFISPVLGAFLAFLIFTMIRSLYLHRASDLPSVEKKFIFLQLITACYIAFAHGSNDVANAVGPLSAALNVMGVTGTEIPIWVLVMGGLGMVIGMATWGYKVVETIGSKITELTPTRGFSAQFATASVVLLHSYSSLPISTTHTLVGSVIGVGLAGGIAAVDLGVIWRIISSWIATVPIAALTSAIIFVGLEVIFL

SEQ ID NO: 18748 - protein, 716 aa, ASPERGILLUS NIDULANS FGSC A4
MATSYAVRTKNPLNLKNSHERSDDFPFSVRTTSLDGWRLTVENGHERLRWEYLKTGKERTAQPQDPASRFYLNLPTSIPGCARAKTPSAAVLNGALYHSQVQVKELGCWAADLSCIFFVTPMLIIAWYITQAVIDEAYAVELVNFILGVQNADGGWPTYSGESTTLMGTILTYVALRLMGLPADEDHLVKARLYLLKMGGAVYLSGWAKFWLAMLGLYKWEGTDPYPVEMWLLPEWFPISPWKWYIIPRQVYLAMSYLSAKRFTMPTNPLLDEIRKEIFVQPYERIDFLAYRGVSLQCSRELRKPWPLILLNWILQNIWIPWLRPIWLAEEGQRRVWDIIKDSNDLTNSTGSVSVDAFLNMIAFYCKEGPDSKALRRIQTASLEYLWMGPRGMQVMSIHAGHTWETAFVLQAYAEGGLSKVPEIQAAIERAYKYLVEQQHVVDYPEDSQCHFFSRLGGWPFSTRYQGNVCSDCTGEALKSILMIERDSRFTRLTTEHQLQLAVDNLIMVQNASGGYSSFEPTRGSELLEYMNGTELFGKMMVEYDFTECTSSCITALALYHQRNPNYRTKAVCTAIDRGIKYILKQQRADGSWLSSWGIACTYGAFFALEALAIGGLNYQNSPAARRGCDFIVKQQLADGGWGETIDAQYPGQEPIRRGVQLLISRQRENGEWRQERAVGSGIVTCELLYHSYIYSFPIRALAMYKAKYGDDAVID

SEQ ID NO: 18749 - protein, 187 aa, Yersinia frederiksenii
ESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 18750 - protein, 555 aa, Azotobacter vinelandii
MCARRPLWFVRAQAIGRPVLPAVGLPAYSYLSGICCEETKYWMVLKALPYAHSQGSPRRPETERQRGVSMRKIENFIAGEYVAAASGRRFDKRSPLDNRVIASIAEAGRAEVDAAVGAARGALAGDWGRLSTEQRVELLYGVANEITRRFDDFVEAEMADTGQPAHVMKQVFIPRGAANFKVFADVVKNVASESFQTATPDGRGALNYALRVPKGVIGVICPWNAPFMLMTWKVGPALACGNAVVVKPSEESPQTAALLGEVMNAVGIPKGVYNVVQGFGPDSAGEFVTQHPGVDAITFTGETRTGAAIMKAASEGMRDVSFELGGKNAGIVFADCDFEAAVEGIFRSAFLNSGQVCLGTERVYVERPIFERFVQALKVKAESVRFGRPDDHDANYGPLISQEHRQKVLSYYRKALEEGATLVTGGGVPEMPGELAEGAWVQPTIWTGLPESAAVVREEIFGPCCHIRPFDAEDEVVQLANATDYGLSTTLWTNDLARAHRLAARVEVGITWINSWFLRDLRTAFGGAKQSGIGREGGVHSLEFYTETRNVCVKL

SEQ ID NO: 18751 - protein, 447 aa, Bacillus subtilis subsp. subtilis str. 168
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 18752 - protein, 422 aa, Pseudomonas putida KT2440
MSDLKTAALEYHAQPRPGKLSVELSKPTATARDLALAYSPGVAEPVREIGRDPELAYKYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEEAKIVCLGAGAAAISCMKLLVSMGAKVENIFMIDRSGVIHAGRDDLNQYKAQFAHATDKRTLADALDGADVFVGLSGPNLLSPEGLKSMAANPIVFACSNPDPEISPELAHATRNDVIMATGRSDYPNQVNNVLGFPFIFRGALDVRAKRINEEMKIAAAIALKDLAKLPVPKEVCEAYGVEGLEFGREYIIPKPLDARLITVVSDAVAKAAIESGVATLPYPKHYPLTSVDEVFNG

SEQ ID NO: 18753 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 18754 - protein, 487 aa, Agrobacterium tumefaciens str. C58
MTLSFDPDSLTLPIGHFIGGRLIPAQNGIDMHRPSDGVEYAGCPRANAALVDEAVQTAKAALKSSNWGGVRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGL

SEQ ID NO: 18755 - protein, 652 aa, Oryza sativa (japonica cultivar-group)
MDRSDSMADSPRRRNGLLRDQVQLVKRKDTNRYEIVRFPDPLSFEKGFFVMIRACQLLVQHNEGMIFVGVAGPSGAGKTVFTEKVLNFMPGVAVISMDNYNDASRIVDGNFDDPRLTDYDTLLENIHGLKEGRSVQVPIYDFKMSCRTGYRTVDVPSSRIVIIEGIYALSEKLRSVLDLRVSVTGGVHFDLVKRVLRDIQRAGQEPEEIIHQISETVYPMYKAFIEPDLQTAHIKIINKFNPFSGFQNPMYILKSPRTITPTDIKVALGEDHTESIEETYDIYLLPPGEDPESCQSYLRMRNREGKYNLMFEEWVTDNPFIISPRITFEVSVRLLGGLMALGYTIAAILKRKSRVFSDGKATVKIDWLEQLNRNYIQVQGRDRNHVKFVAEKLGLDGSYIPRTYIEQIQLEKLINDVMALPEDLKTKLSIDDELVSSPKEALSRVSADKRNKHLKSGLSHSYSTHGDKNIVKLSKLTETNRRFGSGRAPEPPAINQGAITQLSEQISTLNERMDEFTSRVEELNCKFAIKKSSTSQQNLALPNETCNGSAPTNLFVSHLGNGTLIPHSSSSNQLLKESPIVDEINAISRGQRQVIHQLDNLTSLLHEHLALTRQGNAVRRNGILEMDMSICPLIALTIGGFGYLVFKSLNRS

SEQ ID NO: 18756 - protein, 463 aa, Pseudomonas syringae pv. tomato str. DC3000
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 18757 - protein, 185 aa, Glycine max
VKKKIGGGKDKHHDEQDKGFHGFPGGGHHYPPAGYPPQQGYPPAGGYPPAGYPPGAYPPGPGGYPPAPGHGGYPPAGYPAPHHSGHSSGGLGGMIAGAAGAAAAAYGTHHVGHASHNPYGHAGHGGFGHGGFGHVGHASHGYGGHGHGKFKHGKHGGKHGGKFKHGKHGKHGMFGGGGGKFKKWK

SEQ ID NO: 18758 - protein, 588 aa, Burkholderia sp. ICD
MTPSEAFVETLAANGVTEMFGIMGSAFMDAMDIFAPAGIRLIPVVHEQGAGHMADGYARVSGRHGVVIGQNGPGISNCVTAIAAAYWAHSPVVMITPEAGTMGIGLGGFQEAKQLPMFQEFTKYQGHVTHPARMAEFTGRCFDRALAEMGPTQLNIPRDYFYGQIKAEIPQPQRLDRGPGGDQRLDEAAELLAQAKFPVIISGGGVVMGDAIEECKALAERLGAPVVNSYLHNDSFPANHPLWCGPLGYQGSKAAMKLIQRADVVVALGSRLGPFGTLPQHGMDYWPQNAKIIQIDADHKMLGLVKKISVGICGDAKAAAKALTQRLEGRTLVCDASREERAGEIAAEKAAWEKELDGWTHERDPYSLDMIEEQKGERTPGGGNYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAGIARAMGAEGVTVDRLEDVGPALKRAIDAQMNHGKTTIIEIMCTRELGDPFRRDALAKPVRLLDKYKDYV

SEQ ID NO: 18759 - protein, 354 aa, Azotobacter vinelandii
MALISMRQLLDHAAEFGYGVPAFNVNNLEQMRAIMEAADKTDSPVIVQASAGARKYAGAPFLRHLILAAIEEFPHIPVCMHQDHGTSPDVCQRSIQLGFSSVMMDGSLKEDGKTPADYDYNVRVTRQTVAFAHACGVSVEGELGCLGSLETGQAGEEDGVGAEGTLDHSQMLTDPEEAARFVKETQVDALAIAIGTSHGAYKFTKPPTGDILAIDRIKEIHKRIPDTHLVMHGSSSVPQDWLKVINEYGGDIKETYGVPVEEIVEGIKYGVRKVNIDTDLRLASTGAIRRFMGQSPSEFDPRKYLAKTVEAMRDICIARYEAFGTAGHASKIKPLSLEAMFQRYAKGELAAKVN

SEQ ID NO: 18760 - protein, 313 aa, Neurospora crassa
MAEQQKVLGMPPFVADFLMGGVSAAVSKTAAAPIERIKLLVQNQDEMIRAGRLDRRYNGIIDCFKRTTADEGVMALWRGNTANVIRYFPTQALNFAFRDKFKKMFGYKKDVDGYWKWMAGNLASGGAAGATSLLFVYSLDYARTRLANDAKSAKKGGERQFNGLVDVYRKTIASDGIAGLYRGFGPSVAGIVVYRGLYFGLYDSIKPVLLVGDLKNNFLASFALGWCVTTAAGIASYPLDTIRRRMMMTSGEAVKYKSSFDAASQIVAKEGVKSLFKGAGANILRGVAGAGVLSIYDQLQVLLFGKAFKGGSG

SEQ ID NO: 18761 - protein, 291 aa, Streptococcus pneumoniae TIGR4
MTENRYELNKNLAQMLKGGVIMDVQNPEQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDLQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 18762 - protein, 364 aa, Candidatus Blochmannia floridanus
MNNNTYHIAILPGDGIGPEIMQQAYKILNTVKNKFKINIITTEYKVGGNALDLEGSPLPKDTIKNCEKSNAILFGAVGGPKWNNINETSRPEFGALLTLRKHFNLFINLRPIYLPIELINLSPLKPEIISQGLDMICIRELIGGIYFGKPQGKSGIRSQEHAFDTAIYHRFEIERIAHFAFKLAQKRRKHVTSIDKANVLHTSMLWRKVVSEVASNYPNVHLQHLYVDNASMQLIRNPSAFDVILCPNLFGDILSDECAEINGSIGILPSASLNEHNFGLYEPAGGSAPDIAGKNIANPIAQILSTALLFRYSLKLNHVAITIEKAVYKALTLGYRTQDIAYNKQKSVNTDDMGDIIASLIYKL

SEQ ID NO: 18763 - protein, 190 aa, Zea mays
  unsure (1)..(190): unsure at all Xaa locations
VSNASCTTXNCLAPLAKVINDKFGIVEGLMTTVHAITATQKTVDGPSSKDWRGGRAASFNIIPSSTGAAKAVGKVLPVLNGKLTGMSFRVPTVDVSVVGLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 18764 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLNEIREKGIKQMPHTLRRSLEEMLADKQYLKEGQ

SEQ ID NO: 18765 - protein, 182 aa, Pseudomonas syringae pv. tomato str. DC3000
MTFDQSNFKSLIRPVVDFPKPGVVFRDITPLFQSPKATRQVIDSFVQRYIDADFSHIGVMDARGFLIGSVVAYQLNKPLVLFRKQGKLPADVLSEAYQTEYGEAYLEVHADSLCEGNSVIMFDDLIATGGTLIAAANLIRRMGAQVHEAAAIIDLPELGGSKRLNDLNIPTFCLTEFALDEQ

SEQ ID NO: 18766 - protein, 434 aa, Geobacter metallireducens
MPGSEETLRIILDNITPLGVERVDLQSALGRVLARDVVAPWDLPLFDNSARDGFALRSADCTGEGTTLRITGFIPAGCNVSEPVLGGCAVRIMTGAPIPHNCDAVVPGEDTLETDGQVTVMAPVRRRQYIRFRGEDLTGGDLVLTEGTVIQAQEIGLLASFGQAVVPVYRKARVAVLSTGDELIELGEQPSNGRIINSNAQYLAAALREIGAEPILLCIGRDNRESLKEQLQTGLKADALITTAGVSAGARDLVRDVLVEVGVRQMLGKIEMKSGGPKAFGMKDGIPVFSLPGNPLSTMVTFEEFVRPGLLRLMGHRRTVRPNLKARLREDIRKEPGRVHCQSVRVEAENGRYMATTVGNHKACRLSTIQRANAIVILPEGPSVVAAGEEVEVHLLRGDLVLLEEPNLTAGCVPDDRVSEEGETFERRVRVATR

SEQ ID NO: 18767 - protein, 329 aa, Zea mays
  unsure (1)..(329): unsure at all Xaa locations
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTLVPVVTGVIIASGGEPSFHLFGFIMCIGATAARALKTVLQGILLSSDGFXNSTRKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTXXGVILYSESXXRSNKP

SEQ ID NO: 18768 - protein, 267 aa, Triticum aestivum
MASERNGDGGKERAGENGNGGGGGVPLEMPEIRHTKLFINGAFVDAVSGKTFETRDPRTGDVIASIAEGDKKDVDLAVKAAREAFDHGKWPRMPGSERGRIMMKYADLVEGHADELTLLESLDAGKPCTVTRAVDMATAVRSLRYFAGAADKIHGETLKMSRQFQGHTLREPMGVAGLIIPWNFPAIMFFSKVAPALAAGCTMVVKPAEQTPLSALYFAHLAKQAGVPDGVINVITGFGPTAGAAIASHMDVDMVSFTGSTAVGRLI

SEQ ID NO: 18769 - protein, 502 aa, GIBBERELLA ZEAE PH-1
MSPPSIPLIAPNGVKWSQPTGLFINNEFVSSSSSRTLTSIDPATENEIATVQAADAQDIDKAVKAAKAALRHPSWKDLPASDRGQLMARLADLIEAKRELFATIDAWDNGKTYIETLENDLVEAVGVIRYYSGWADKTFGQTINTTPQKFAYTIRQPIGVIAQIIPWNYPLSMATWKLGPALACGNAVVIKAAEQTPLSLLVLGELIKEAGFPPGVVNIVNGLGKDTGAALVQHPLVDKIAFTGSTATAANIMGVAAKTLKNITLETGGKSPLIVFDDAEMDQAVKWSHFGIMSNQGQICTATSRILVQETIYEEFIKKFIDTLNTVSKVGDQWDKTTYQGPQVSKVQYERILEYIEIGKKEGATLAAGGGPLKINGSDKGFYISPTVFTDVKPSMRVFREEIFGPVVVVSTFKTEEEAIELANDTTYGLGAAAFTTNLEKAHRVAAAIEAGMVWINSSQDCDPRVPFGGVKQSGIGRELGEAGLEAYTQIKSVHINMGNRL

SEQ ID NO: 18770 - protein, 93 aa, Salmonella enterica
SLAKNGTNLFSGDKYAGLSEQALYYIGGVIKHAKAINALANPTTNSYKRLVPGYEAPVMLAYSARNRFRLHPYSGGGVSESAPYRSSLPGPGG

SEQ ID NO: 18771 - protein, 540 aa, Candida tropicalis
MSSSPSFAQEVLATTSPYIEYFLDNYTRWYYFIPLVLLSLNFISLLHTRYLERRFHAKPLGNFVRDPTFGIATPLLLIYLKSKGTVMKFAWGLWNNKYIVRDPKYKTTGLRIVGLPLIETMDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDESIGLTPTTKDFDGRRDFADAFNYSQTYQAYRFLLQQMYWILNGSEFRKSIAVVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINETLRLYPSVPHNFRVATRNTTLPRGGGEDGYSPIVVKKGQVVMYTVIATHRDPSIYGADADVFRPERWFEPETRKLGWAYVPFNGGPRICLGQQFALTEASYVTVRLLQEFAHLSMDPDTEYPPKLQNTLTLSLFDGADVRMY

SEQ ID NO: 18772 - protein, 193 aa, Haemophilus influenzae Rd
MKLLIINNHDSFTFNLVDLIRKLNVPYDVLNVEDLKENTAENYSHILISPGPDIPRAYPQLFSMLEKYYQQKSILGVCLGHQTLCEFFGGTLYNLENVRHGQKRTLKVRSNSPLFFDLPTEFNIGLYHSWGVQEEDFPDCLEITALCDEDVVMAMQHKSLPIYSVQFHPESYMSDFGEKILRNWLAIPPTTNP

SEQ ID NO: 18773 - protein, 203 aa, Glycine max; identical to SEQ ID NO: 2850

SEQ ID NO: 18774 - protein, 203 aa, Glycine max
  unsure (1)..(203): unsure at all Xaa locations
MGNTEKLMNQIMELKFTSKSLQRQSRKCEKEEKSEKLKVKKAIEKGNMDGARIYAENAIRKRTEQMNYLRLASRLDAVVARLDTQAKMTTISKSMGNIVKSLESSLATGNLQKMSETMDSFEKQFVNMEVQAEFMESAMAGSTSLSTPEGEVNXLMQQVADDYGLEVSVGLPQPAAHAVPAKEADKVDEDDLSRRLAELKARG

SEQ ID NO: 18775 - protein, 275 aa, Antirrhinum majus
CENWGFFELVNHGITPEFMDTVEKLTKEHYKKTMEQRFKEMVASKGLEAVQSEINYLDWESTFFLRHLPVSNISEVPDLEDQYRKVMKEFALQLEKLAEELLDLLCENLGLEKGYLKKAFYGSKGPTFGTKVSNYPPCPKPNLIKGLRAHTDAGGIILLFQDDKVSGLQLLKHGEWVDVPPMRHSIVINIGDQLEVITNGKYKSVMHRVIAQTDGNRMSLASFYNPGSDAVIYPAPALVEKEETKDLYPKFVFEDYMKLYTTVKFQAKEPRFEAM

SEQ ID NO: 18776 - protein, 160 aa, Helianthus annuus
MDIDSLMGFDPLLRNLHYILEATDDNTTGNKSNNSGPSRAYVRDARAMAATPADVKECPNSYVFIVDMPGLKSGDIKVQVERDNVLVISGKRNREEEKEGVKYVRMERRMGKFMKKFALPEDANTDKISAICQDGVLTVTVEKLPPPEPKKPKTIQVQVA

SEQ ID NO: 18777 - protein, 323 aa, Pseudomonas aeruginosa UCBPP-PA14
MIQVVTGEWKSRCVYVATRLGLADLIESGIDSDETLAAAVGSDAERIHRLMRLLVAFEIFQGDTRDGYANTPTSHLLRDVEGSFRDMVLFYGEEFHAAWTPACEALLSGTPGFELAFGEDFYSYLKRCPDAGRRFLLAMKASNLAFHEIPRLLDFRGRSFVDVGGGSGELTKAILQAEPSARGVMLDREGSLGVARDNLSSLLAGERVSLVGGDMLQEVPSNGDIYLLSRIIGDLDEAASLRLLGNCREAMAGDGRVVVIERTISASEPSPMSVLWDVHLFMACAGRHRTTEEVVDLLGRGGFAVERIVDLPMETRMIVAARA

SEQ ID NO: 18778 - protein, 484 aa, Neurospora crassa
MHVVSSGPPDEFPSGLPHRDTHTSEVEPPKDQQHPVKWYRSSMFNVTIVGVCSFACPGIWSAMNSLGAGGAASPNLINAANAITFSLMVLSSYLSSTHHSIGYAPFAAGLYTNNRYGNEWFVLLGAALCGISAGVFWAAEASIAIAYPEPWNRGKALGYWLSFKLFAQMLGGAINFGLNANNDRAGQVSYTVFLVFIAIQASGPFIGFLLNSPDNVERKDGKKVDLTITQNPWREIKATTKLFFTKKFLLLLLWIGNAVFSESVFFTYLAMWFSVRSRALGSLMSGIVPVIAGNILGYWLDRGSISLKVRSRVAFWTLVIFQGAWWTWATVLVTRFKETKPTYDWATPGFGAAFGVFIFLAVSFQLNYLFSYFIVHNIAESDEEIIRYAALLRGTESAWQALSYGLESLTLFTATGGVYMSFVIWAVAIYPAWHLLRHFGVHTSRPLAGDDSYSASIERVKEKGAISSATSSGDEAGNESTSKA

SEQ ID NO: 18779 - protein, 390 aa, Campylobacter jejuni subsp. jejuni NCTC 11168
MLIKLNDYEKNITQKIKDLKNASGSHSPSIFTMAEQIPELNIKIDSCFLSNPYATALFLRYLKEELIDGQKLRSVLEFYPSQNSIIAKTVADFIGIDPKNVFIGNGAIEIIQAVMHNFVGKKIIVNIPTFSSYYEFAKSETNVVYYQLSKEDNYNLNIEHYLNFVKNENPDSVVLINPNNPDGGYINYEKLRYILSELKYVKNIIIDESFIHFAYENKDYNGINIEYLFKEFHNTIIIKSMSKDFGVAGIRIGYAIMSEDKIRGLLKNGYLWNSSGLSEYFLRLYVRKNFFDEYDKVRREYIQETQTFFRKLSGIKQFKVYPSMANFALVELLDGSSSTDFVAKMLIKYGIYMRTCNDKIGLEGEFIRIASRTLEENDMVLKSICDVFKE

SEQ ID NO: 18780 - protein, 603 aa, Oryza sativa
  unsure (1)..(603): unsure at all Xaa locations
MELALVGNPSNGVAKPSCNSVGSLPVVSSNAVIHPPVTSAARATLGRHLARRLVQIGATDVFAVPGDFNLTLLDYLIAEPGLKLIACCNELNAGYAADGYARALVGAFVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAIAESSGYPFAVMXPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 18781 - protein, 215 aa, Fagus sylvatica
MARRADEEYDYLFKVVLIGDSGVGKSNLLSRFTRNEFCLESKSTIGVEFATRTLQVEGRTVKAQIWDTAGQERYRAITSAYYRGAVGALLVYDVTKPTTFEQVWLKELRDHADSNIVIMLIGNKTDLKHSRAVRTEDAQGFMLRKKALSFIETSALKATNVEKAFQTILCLRFTGIISKKSLSSDEPAPSVIKEAVKHIVVGGSEANTKKPCCSN

SEQ ID NO: 18782 - protein, 373 aa, Heliobacillus mobilis
MTNDPLRWVRQDIRDIVPYQAKVYPEGVKVDANENPFPWPQRYVERLQQELAFYPFTRYPDGEAKELRQALSEYTGRNAAEILVSNGSDEAIQLVLLTFGGPGLATVVSNPTFVMYSMATRYMGGNVIDVPLNEEGNTFRLDVQGLLAAAAREEARVIIICNPNNPTGNCFAEEDILAVVRGTDKIVIVDEAYYEFAGKSLMGRLDEFPNMVIMRTFSKAFGLAGLRVGYTVASAEIINEIHKVRQPFNVNAFSQRAATIAIEERTAFEAQVKEVLAERETLCAELGRFAWQVFATDANYIFLRLPGSTKEEQVRRAAEIHQGLMDRGVLVRKLGGGPGLDGTLRVTVGRPEENRKLLAALGDLADPSTGGWR

SEQ ID NO: 18783 - protein, 156 aa, Zea mays
RPGFLVLIPRVPRDPRQAHFLVARAGVLAGVRLPVAPPREPAHLLLPLRRRGRAVRLPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFM

SEQ ID NO: 18784 - protein, 204 aa, Eremothecium gossypii
MARNPAAGLENTLFQLKFTAKQLTRQAAKAAKEEKQETNKLKKIIGESEEIARLYASNAIRKRNERVQLLKLASRVDAVVSKVQTAVTMRQVSGSMAQVCKGMDRALQSMNLQQITMIMDKFEQQFEDLDTSVNVYEEMGQNVDAVVVDNDKVDELISQAADEKGLELKQSAQLGELPRVQNAPAEVTEDKEDKLAQRLRMLRG

SEQ ID NO: 18785 - protein, 348 aa, Pycnococcus provasolii
VELRDGDKSMWMGKGCSKAVANLNDIIAPALVGKDPTQQKAIDDLMNKELDGTENKGKLGANAILAVSMAVCKAGAAEKDIPLYKYIAELAGNTKLILPVPAFNIINGGSHAGNKLAMQEFMTLPTGATSFTEAMKMGTEVYHNLKSVIKEKYGQDACNVGDEGDFAPNIESNKEGLDLVNQAIEKADSTGKVKIGMDVASSEFYTEDKMYDLDFKTKDNDGSQKKTGEEMLEMYKSFCSEYPVISIEDPYDQDDFENTAALTAEGVCQVVGDDLLVTNPTRVASAIEGKTCNALLLKVNQIGSISEAIEAVRMSKEAGWGVMTSHRSGETEDSFIADLAVGLATGQI

SEQ ID NO: 18786 - protein, 95 aa, Triticum aestivum
KLRPTSSFHTKTTTTNSRQAVWNDNEALTISSCGPILIEDYHLLEKIGHLARERIPEGVVDAPSTLRNGFLEGTHDVTGLTWAELLRLPGGCTPG

SEQ ID NO: 18787 - protein, 193 aa, Triticum aestivum
MIQGTVIIYIFSALTCWYKRGSLQFIVDWTVCDGRRHQHQSVSEMFIAGLNYEMDHQPQGTLVPAVMLLQQLRPTNQLLISCWSWPQARKRVQHCTVYWPPWDKSMSMDFVETKGSLNYFRYAYDPSVSHVQKLFEATKSANDLNTIAAILDKYPYHPDSLLPFADMFKYSGEHHSSADAVEKCLFALECAWH

SEQ ID NO: 18788 - protein, 579 aa, Staphylococcus epidermidis ATCC 12228
MAQIKANEALVKALQTWNIDHLYGIPGDSVDAVVDSLRTVRDQFKFYHVRHEEVASLAAASYTKMTGKIGVALSIGGPGIVHLLNGMYDAKMDNVPQLIIAGQTNSTLLGTKFFQETNISKMVDDVAVYHHQIQKGDNVFEITNEAIRTAYEKKGVSVIICPNDLLTQKIKDTTNRAVDTTKPKPASPKFKSIKKAAKLIDKAKKPVMLIGLGTQHAKDELREFIEAAKIPVIHTLPAKTILPDDHPYSIGNLGKIGTKTSYQTIQDADLLIMAGTNYPYVNYLPKKNIKAIQIDTNEENIGARFKINVGILGDSKVAFHQLTENIKHVAKRPFLDKTLERKAVWDKWMKQDLNNDNSPLRPERLMKAINANLKDDAIISADVGTSTVWSTRYLNLSVNNKFIISSWLGTMGCGLPGAMAAKIAYPNRQAVAITGDGAFQMVMQDFATAVQYNLPMTIFVLNNKQLSFIKYEQQAAGELEYAIDFSDMDHAKFAEAAGGKGYVVRDVSRLDDIVEEAMAQDVPTIVDVHVDPNAAPLPGKIVNEEAFGYSKWAYRSITEDKNLDFDQIPPISVAAKRFL

SEQ ID NO: 18789 - protein, 473 aa, Ralstonia metallidurans
MKTLDRFYIDGQWVTPAAAARSMPIVNPATEEVAGHVTLGSAEDVNRAVAAARAAFPAWSETSREERLALLERITALYKARLGDFAEAVRTEIGAPVSLCNTLQAPIGLAHLGAATETLRAFQFETAHGNNYVRHEPIGVAALITAWNWPLSLICAKVAAALAAGCTIVLKPSEIAPLDAALFAEVMHEAGTPAGVFNMVFGDGQEVGARLAAHPDVDVISITGSTRAGIAVAQAAAATVKRVHQELGGKSPLLILDDADLQAAVAQGVGHVMLNSGQTCIAPTRMLVPRDRYDEAVRVAAATANALQVGDPAEPGTRIGPISNKAQYEKVQRMIGTGIEEGARVVAGGPGRPDGLTRGFYARPTIFADVDNSMTIAREEIFGPVLVMIPYDDEAQGVDIANDTPYGLAAYVASGDPARARRVAARLRAGSVRINGGQVDLSMPFGGYRASGNGRENGAHGLAEYLEVKAVTV

SEQ ID NO: 18790 - protein, 353 aa, Zea mays
  unsure (1)..(353): unsure at all Xaa locations
MRQISSLLQGLARSLSVGRDRDRDRDRKGNGAGDGKTAVPAVLRTSGTLWGDGSDTFAAVCSRRGEKGINQDCSIVWEGFGCQEGTIFCGIFDGHGPWGHYVAKVVRDSLPPSLLCHWQEALALASLIDDGKKKLGDCQFDLWKRSYVAACAAVDDELRRSRRLDAVQSGCTALSIVKQGDLMVVANVGDSRAVLGTTYGDGTIVAVQLTVDLKPNLPQEKERIRRCNGQVYCLADEPGVHRVWQPSRESPGLAMSRAFGDYCVKDXGVISTPEVTQRRIGASDQFVILATDGVWDVLSNDEAVQIVAGTLDRAKAAKRLVECAVRAWRRKRRDIAVDDCSAICLFFHPSPPS

SEQ ID NO: 18791 - protein, 364 aa, Shigella flexneri 2a str. 301
MMSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 18792 - protein, 227 aa, Triticum aestivum
  unsure (1)..(227): unsure at all Xaa locations
MMAPRRSAAETADADRARLHQLGYKQELKRGLSAVSNFAFSFSIISVLMGVTATYNTGLRYGGPASMTLGWLVVTVFNGCVALSMAEICSAYPTSGGLYYWSAKLAGKEWAPLASWVTGWFNIVGQWAGTTXSVDFSLAQLIQVIILLSCXGRRAPARANGGGYTASKYVVLAIHGFFLVLHGLINSLPIRGLSWCGKLGAFGYSAGAFTLVILIPAVAKERASAKF

SEQ ID NO: 18793 - protein, 446 aa, Ahnfeltiopsis leptophylla
  unsure (1)..(446): unsure at all Xaa locations
LFRVSPQPGVDPVEASAAVAGESSTATWTVVWTDFLTACDLYRAKAYKVDAVPNTSDQYFAYIAYDIDLFEEGSIANLTASIIGNVFGFKAVKALRLEDMRLPVAYLKTFQGPATGIVSERERMDKFGCPFLGATVKPKLGLSGKNYGRVVYEGLKGGLDFLKDDENINSQPFMRWKERYLYAMEGVNRAVAGAGEVKGHYLNVTAATMEDMYERAEFAKQLGSIIVMVDLVIGYTAIQSMAIWARKNDMILHLHRAGNSTYSRQKIHGMNFRVICKWMRMAGVDHIHAGTVVGKLEGDPXMIXXXXXXXLLPYLEVNLPQGIFFEQDWASLRKVTPVASGGIHCGQMHQLLDYLGVDVVLQFGGGTIGHPDGIQAGATANRVALESMVIARNEGRDYVAEGPQILQDAAKTCGPLQTALDLWKDITFNYTSTDTADFVETPTANV

SEQ ID NO: 18794 - protein, 132 aa, Mangifera indica
MASSSTKMLIIFMVVSSFMLASANFYQNFDITWGDGRAQILNNGDLLTLSLDKASGSGFQSKNEYLFAKIDMQLKLVPGNSAGTVTAYYLKSAGSAWDEIDFEFLGNLSGDPYTLHTNVFSQGKGDREQQFH

SEQ ID NO: 18795 - protein, 408 aa, Triticum aestivum
  unsure (1)..(408): unsure at all Xaa locations
MEAPPGPEPMALDAPPPLAAAVVPAHAATEKTRTEGGDPVTGHIISTTIGGKNGEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYVHTVPGVCHRDVKPQNVLVDPLTHQVKICDFGSAKVLVPGEPNIAYICSRYYGAPELIFGATEYTTSIEERPTTGCVLAELLLGQPLFPGETAVDQLVEIIKVLGTPTREEIRCMNPNYTEFRFPQIKAHPWHKISLAPDXFHKRMPAEAIDLASRLLQYSPNLRCTALDACAHSFFDELREPNARLPNGRPFPPLFNFKPELANASPELINRLVPEHVRRQNGPNFAHAGS

SEQ ID NO: 18796 - protein, 353 aa, Nostoc sp. PCC 7120
MTNYFRSNVEAMASYVPGEQPPQGTQVIKLNSNENPYPPSPEALAAIKDIDGECLRRYPEPFGEEFRKAVSQLLGVPCNWVIVGNGSDEILSIVIRACAEPTRKVVYPVPTYVLYRTLTEMQAADILEIPYREYNILPVADLIAAHGSVTFIASPNSPSGHVVPSDDLRKLASELSGVLVIDEAYVDFAEESALNLVQDHENVILIRTLSKGYSLAGLRLGFGVGNPQLLNGLFKVKDSYNVDAIACKVATAAITDQAYKNACVAKVKASRTRLAKDLKQLGFCVWDSQANFLLTQPPQGNAEYLYQQLREKKILIRYFKQPGLEDKLRITVGTDEQNQILLQALRDLLESRD

SEQ ID NO: 18797 - protein, 433 aa, Pinus taeda
MRVEELGGILKPASDLEAAANAKEKLKEKHQLPKESNRMVKHGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 18798 - protein, 467 aa, Brucella suis 1330
MNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVSGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGRRASVVMVFIFFAFVLWALTQEPDTLAAMKVTPLWFVLLGIAYRVMKLKQKQS

SEQ ID NO: 18799 - protein, 365 aa, Populus kitakamiensis
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPNADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIEFRKKA

SEQ ID NO: 18800 - protein, 337 aa, Pseudomonas
KEVENQQKLANVVILATGGTIAGSGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYSAVAVASNKDSRGKGVLVTMNDEIQSGRDVSKSINIKTEAFLSAWGPLGMVVEGKSYWFRLPALRHTVNSEFDIKQISSLPGVDIAYSYGNVTDTAYKALAQNGALAIIHAGTGNGSVSSRLTPRLQTLRKTGTQIIRSSHVNQGGFVLRNAEQPDDKNDWVVAHDLNPQKARILVELAMVKTNDSKEIQRIFWEY

SEQ ID NO: 18801 - protein, 548 aa, Corynebacterium glutamicum ATCC 13032
MSQERPQIGSRLSRVIEQDGLQFRDLDGDGVLAPYEDWRLTPAERAADLVKRMNVEEKAGLMIIGSHYPGYSPLAPESEGKDAEKCEPLLNPVDMWREDNPITGVPFTEPVLATSSTENAINLRNQRYLIVRDNLPARGLATWTNAVQEVAERSRLGIPVAFASNPRNHVALVAQFGVNESAGVFSEWPGELGLAALRDAELMETFGTEAAKEWRAGGVHKLYGYMADLASEPRWSRFNGTFGEDPELISDYIAAVVRGLQGPELSKNSVSTTIKHFPGGGVRLDGHDPHFHWGQTNEYPTEDALGKYHLPPFQAAIDAGCASIMPYYARPMNNSANQLDQQLWQNPTTQFEEVAFAYNRTFIQDLLRDAMGHRGYVNSDSGVIDAMMWGVEELSEPERFAAAVRAGTDIFSDMANPRRLLEAVAEGHLDESELNQPVQRLLEEIFQLGLFENPYVSEDEAEKIIGAPEVSALGNKAQLDSVTLLRNNPIRAATGSCSKPEDLPIGYWPYQDRRGSTTAGSSHSRRTPRGNLGVFRVRSRSCNRVGSP

SEQ ID NO: 18802 - protein, 263 aa, Triticum aestivum
  unsure (1)..(263): unsure at all Xaa locations
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHIRRKLTSRGIDPVTHRAINSDHAASNITISFEAAQRDDKGAVFRRDAEPTKVAAAAAAITHVDHHHRSNPHHQMEWGQGKPLKCPDLNLDLCISPPSHEDPMVDTKPVVKREAVVGLCFSCSMGLPRSADLQCSSFMGLRTXMLDFRSIEMK

SEQ ID NO: 18803 - protein, 455 aa, Erythroclonium muelleri
  unsure (1)..(455): unsure at all Xaa locations
VDKDTDILALFRVSPQPGVDPIEASAAVAGESSTATWTVVWTDLLTACDLYRAKAYKVDAVPNTSDQYFAFIAYDIDLFEEGSIANLTASIIGNVXGFKAVKALRLEDMRIPVAYLKTFQGPATGIISERERMDKFGRPFLGATVKPKLGLSGKNYGRVVYEGLRGGLDFLKDDENINSQPFMRWKERYLYAMEGVNRSVAATGEIKGHYLNVTAATMEDMYERAEFAKQLGSIIIMIDLVIGYSAIQTMGIWARKNDMILHLHRAGNSTYSRQKIHGMNFRVICKWMRMAGVDHIHAGTVVGKLEGDPLMIRGFYRTLLLAHLEVNLPQGLFFEQDWASLRKVTPVASGGIHCGQMHQLLDYLGIDVVLQFGGGTIGHPDGIQAGATANRVALESMVLARNEGRDYVAEGPQILQDAAKTCGPLQTALDLWKDITFNYTSTDTADFVETPTANV

SEQ ID NO: 18804 - protein, 248 aa, Triticum aestivum
MKGGGDVEAGGDIEAGTAAPKGAPYAGTTESPELRWALIRKIYVVLCLQLLLTAAVAAVFVTVTAIPHFFVSSYAGLGLYIFILVFPFIVLCPLHIYRQKHPINLLLLGVFTVAISFSVGLTCAFTSGKVILQAGILTIVVVLSLTAYTFWAARRGKDFSFLGPFLFASLMILLVFAFIQIFFPLGKLSHMIYGTLAALIFSGYIVYDTGSIIKRYKYDEYVWAAVTLYLDIINLFLGLLTLFRACDN

SEQ ID NO: 18805 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAADLTKRIQNAGTEVVEAKAGGGSATLSMGQAAARFGLSLVRALQGEKGVVECAYVEGDGQYARFFSQPLLLGKNGVGERKSIGTLSAFEQRSLEG

SEQ ID NO: 18806 - protein, 335 aa, Rosa hybrid cultivar 'Kardinal'
MGVERVQDIASATSKDTIPVEFIRSENEQPGITTVPGTVLECPIIDFSDPDEEKLLKQIFEASTDWGMYQIVNHDISNEAIAKLQAVGKEFFELPHEEKEVYAKDPNSKSVEGYGTFLQKELEGKKGWVDHLFHKIWPPSAINYCFWPKNPASYREANEEYAKNLHKVVEKLFKLLSLGLGLEAQELKKAVGGDDLVYLLKINYYPPCPRPDLALGVVAHTDMSALTILVPNDVQGLQACRDGQWYDVKYIPNALVIHIGDQMEVMSNGKFKAVLHRTTVSKDKTRISWPVFLEPPPDHIIGPHPKLVNDKENPPKYKTKKYSEYVYNKLNKIPQ

SEQ ID NO: 18807 - protein, 430 aa, Arthrobacter nicotinovorans
MQRQEEQLTGLAGNRSGLGTIGKSLPEHEHRSVSVHRQAIRDVLFPLLTPPRVERIPLMQAMGRGLAETIHAPTNLPPFTNSQMDGYAVRSRDTAGGQGGLRVAAPIPAGAVPAPLVGGTAAQIMTGALIPDGADAVVPVERAVPNHFPPPGLDRTVRLPEIAAGTYIRSAGSDIATGECALSAGTVLGPRQLGLLAALGITEVVVNQKLTVLLATTGDEVLEPGEKLALGKIYDANNTLLQSSMLQAGLNVIRAGIVKDEPGALSKLLRSHTAHVDLIVTSGGVSAGAYEPVRQAMIDHDVEFSHVAIQPGGPQGVGTFEGIPVLAFPGNPVSCFVSFEMFLRPLLSEMFASAHTSTLLPRPPFASPDVTPKKAPGFRRGVLSADGTIRLEGGEGSHLLGALARSNVLVHIPRGNFGTGQGIGSGGMAV

SEQ ID NO: 18808 - protein, 404 aa, Haemophilus somnus 2336
MLSLEQALQQMLSQLATINKTETLTLEQAVARICAEDIISPINVPSFDNSAMDGYAVRLADLKHSTTLSICGKSFAGNPFNEQWQEKSVIRIMTGAMLPEGTDAVVMQENVTINEDGTVTINEIPKLHQNIRRLGEDIKVGDIALKMGSKLTARSLPLLASLGISHVKVYKKPKVALFSTGDELVSVGQPLVQGKIYDSNRFTIRLMLEKFPCDILDFGILPDDEQLFEQTFFKAQKQADLVISSGGVSVGEADFTKAVLEKCGEINFWKIAMKPGKPFAFGKLNNAWFCGLPGNPVSALVTFYQLVQPVIAKLSGYTQWKMPQQLKAISATKLKKSIGRIDFQRGFYQLNTQGQIEVYPVGQQGSHLFSAFVNSNCFIRLEQERGNVEAGSIVTIEPFSDILN

SEQ ID NO: 18809 - protein, 462 aa, Nicotiana sylvestris
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 18810 - protein, 193 aa, Vibrio cholerae
KACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEALLDIGKLSAYEQAALDGMLDTLKGDI

SEQ ID NO: 18811 - protein, 445 aa, Ricinus communis
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 18812 - protein, 459 aa, Chrysochromulina spinifera
DPDYVIKETDILALFRCTPQPGVDPVEAAAALAGESSTATWTVVWTDLLTACDLYRAKAYRVDPVPSAADTYFCYIAYDIDLFEEGSLANLTASIIGNIFGFKAVKALRLEDMRFPVALLKTYQGPATGLVVERERMDKFGRPLLGATVKPKLGLSGKNYGRVVFEGLKGGLDFLKDDENINSQPFMRYRERFLYSIEGVNHAASLTGEVKGHYLNATAATMEDMYERAEFAREIGSIIVMIDLVIGYTAIQSMSIWARKTDMILHLHRAGNSTYSRQKNHGMNFRVICKWMRMAGVDHIHAGTVVGKLEGDPLMIKGFYNTLLDTKTQINLPEGLFFAQDWASLRKCVPVASGGIHCGQMHQLINYLGDDVVLQFGGGTIGHPDGIQAGATANRVALECMVLARNEGRDYIAEGPQILRDAAKSCGPLQTALDLWKDITFNYASTDTADFVDTATANR

SEQ ID NO: 18813 - protein, 307 aa, Zea mays
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNEVDDGDVGAHP

SEQ ID NO: 18814 - protein, 275 aa, Vibrio parahaemolyticus RIMD 2210633
MNKSILITGCSTGIGYVCAHALHKQGFHVIASCRKLDDVQRLQSEGLTCIQLDLDDPISITSGAKQAIELAQGQLYALFNNGAYGQPGALEDLPTEALKAQFQTNFFGWHQLVQEVLPTMRAQGEGRIIQNSSVLGFAAMKYRGAYNASKFALEGWTDTLRLELADTDIKVALIEPGPIETQFRHNALLAFEQWIDVDSSPHRIAYDGQKKRLDNDKSNNRFVLPAEACIEPVLHALTSNKPKIRYRITTPTKLFAILKRLLPTRVLDKILRQAA

SEQ ID NO: 18815 - protein, 523 aa, Nicotiana tabacum
MSADNNLQVLNALDVAKTQLYHFTTIVIAGMGFFTDAYDLFSISLVTKLLGRLYYTKSDLLKPGTLPPTVSASVTGVALVGTLAGQLFFGWLGDKMGRKTVYGMTLIIMVLCSVASGLSFGSTPKGVMATLCFFRFWLGFGIGGDYPLSATIMSEYANKKTRGAFIAAVFAMQGFGILFSGIIALIVSAGFDHAYNVPSFQENAALSTVPQADYIWRIILMFGALPAFLTYYWRMKMPETARYTALVAKDAKRAAQDMGRVLQVEIDPEDAKIEQMSRDETNKFGLFSWEFVCRHGLHLFGTCSTWFLLDIAFYSQNLFQKDVFSAVGWIPAAKTMNAVQEVYKIARAQTLIALLSTVPGYWFTVAFIDIVGRFAIQLMGFFFMTVFMFAIAIPYEHWTKKDNHIGFVAMYALTFFFANFGPNATTFVVPAEIFPARLRSTCHGISAAAGKAGAIVGAYGFLYAAQSKDPTKTDAGYPAGIGIKNSLLALGAINALGMVCTFCVPESKGKSLEEASQETITEE

SEQ ID NO: 18816 - protein, 356 aa, Wigglesworthia glossinidia endosymbiont of Glossina brevipalpis
MSNILDSINTGVIYGKDIEKLFSFAKEKKFAIPAINCIGTDSINAALEAASIYRSPIIIQFSHGGSSFIAGKKMNCNKGAILGAISGALHVHNISKEYKIPVILHTDHCSKNILPWIDELLKESEKRFFNFGKPLFSSHMIDLSSEPLEENIKISKKYLEKMKRLNIILEIELGCTGGEEDGIIGEKANDNKLYTNPKDVCYAYENLTKVGSNFIVAASFGNCHGVYNPGNVKLKPCILQLSQEYVSKKFRLNKNPLNLVFHGGSGSSYEDIKKSIEYGVIKMNIDTDTQWATWNGVLNFYKKNKNYLKSQLGNPEGKNKPNKKFYDPRNWISHAKNSMIIKLKSIFKLLNSINVL

SEQ ID NO: 18817 - protein, 419 aa, Staphylococcus aureus subsp. aureus MW2
MVVEKRNPIPVKEAIQRIVNQQSSMPAITVALEKSLNHILAEDIVATYDIPRFDKSPYDGFAIRSVDSQGASGQNRIEFKVIDHIGAGSVSDKLVGDHEAVRIMTGAQIPNGADAVVMFEQTIELEDTFTIRKPFSKNENISLKGEETTTGDVVLKKGQVINPGAIAVLATYGYAEVKVIKQPSVAVIATGSELLDVNDVLEDGKIRNSNGPMIRALAEKLGLEVGIYKTQKDDLDSGIQVVKEAMEKHDIVITTGGVSVGDFDYLPEIYKAVKAEVLFNKVAMRPGSVTTVAFVDGKYLFGLSGNPSACFTGFELFVKPAVKHMCGALEVFPQIIKATLMEDFTKANPFTRFIRAKATLTSAGATVVPSGFNKSGAVVAIAHANCMVMLPGGSRGFKAGHTVDIILTESDAAEEELLL

SEQ ID NO: 18818 - protein, 460 aa, Xanthomonas axonopodis pv. citri str. 306
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 18819 - protein, 501 aa, Sphingomonas chungbukensis
MATQLKSTENDYGIKSEYGHYIGGEWIAGDSGKTIDLLNPSTGKVLTKIQAGNAKDIERAIAAAKAAFPKWSQSLPGERQEILIEIARRLKARQSHYATLETLNNGKPMRESMFFDMTQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVESYLQLATEEGAEVLTGGTRADAANLAGGNFIKPTVFTNVKNTMRIAQEEIFRPVTTVISWNDQTHMMQQANATTYGLAGGVWTKDLARAHRIARQLETGTVWINRYYNLKANMPLGGYKQNGFGREFSHEVLNHYTQTKSVVVNLQEGRVGMFDQ

SEQ ID NO: 18820 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 18821 - protein, 175 aa, Triticum aestivum
MAPAVMASSATTVAPFQGLKSTAGLPVSRRSGSASLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 18822 - protein, 432 aa, Streptococcus mutans UA159
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 18823 - protein, 798 aa, Geobacillus stearothermophilus
MFTDKETFKQAFLIRLETLCGKQFEESTTRDHYYVLGHMVREHISRHWIATNERNRAQKRKQVYYLSIEFLLGRLLGSNLLNLGVRQVVEEGLRDLGIRLEDVEESEADAGLGNGGLGRLAACFLDSLATLNLPGHGHGIRYKHGLFDQKIVDGYQVELPQQWLRHGNVWEIRKEELAVEVNFWGKVEVYEQNGCLVFRHIDSKKVMAVPYDMPVIGYGTNTVNTLRLWNAEPAKTFPLHKDVMQYKRETEAISEFLYPDDAHDEGKILRLKQQYFLVAASLGSIVRAHRLQHGNLHQLHEYVAIHVNDTHPVLAIPELMRILLDEEGMSWEEAWHITTHTIAYTNHTTLSERLRMAIHLFQPLLPRIYMIVEEINERFCRELWERYPGDWGRIEQMAIIAHGVVKMAHLAIAGSHSVNGVAKLHTEILKQREMRLFYEWAPHKFNNKTNGVTHRRWLLKANPELSALITDTTGSRWIHEPETLIELKPHASDPAFQQALSAVKQQRKGKLAARIYEKTGIRVDESSIFDVQVKRLHAYKRQLLNVLHIMYLYNRLKEDPHFSIYPRTFIFGAKASPGYYYAKRIIKLIHSVADKVNNDKQTNEQLKVIFLENYRVSLAEEIFPAADVSEQISTASIEASGTGNMKFMMNGALTLGTLDGANVEIAEAVGKENMFLFGLTAEEVLNYYEHGGYRAHEYYHHDKRIKQVVDQLVNGFFPDVADYFEPIYDSLLTQNDEYFVLRDFAAYTEAHERVEAAYRDPARWWYMSAVNIAHSGYFASDRTIAEYAVDIWGISPSM

SEQ ID NO: 18824 - protein, 425 aa, Oryza sativa (japonica cultivar-group)
MDTGADQAPPPPPPPPVAAASAAADEPRDLRVVREILHSLGLREGDYEEAAVHKLLLFAHRYAGDVLGEAKAYAGHAGRESLQADDVRLAIQARGMSSAAPPSREEMLDIAHKCNEIPIPKPCVPSGSISLPHYEDMLLNKKHIFVPRVEPTPHQIEETEDDYNDDGSNANVASPNSNYDQDLFGSISLPHYQDMLLNQNHLSVHRVEPAHDQLEKIKDDGSNDNADSSHSNYVQDSSGSVSLQHHQDMSLNQNHLFVHQVELTLDQIEEIKDDGSNDNVDSPNFNCVQDPSRSVSFPHYQVMPLNQNHLSFHQVEPMLDQVEEIKDDSSNDNVASLDSNCIQDPHYQDMLLNQDHLSVRGVEPTLDQVEEIEDDCSSDNVASPDSNYDKEKNDSNKQKPSKKVSQLNTLVAAGKDKVDCSTELS

SEQ ID NO: 18825 - protein, 528 aa, Bacillus circulans
MNKKWLNIPALIALLAAIAFGSVAPAEAAPATSVSNKQNFSTDVIYQIVTDRFVDGNTANNPAGSAYDATCSTNLKLYCGGDWQGIMNKINDGYFTGMGITALWISQPVENIYSVINYSGVNNTAYHGYWARDFKKTNPAFGSMTDFANLISAAHSRNIKVVIDFAPNHTSPAMETNASFGENGKLYDNGTLLGGYTGDTNGYFHHNGGTDFSTLKNGIYKNLYDLADLNHNNSTIDTYFKNAIRLWLDMGIDGIRVDAVKHMPFGWQKNWMSSIYSYKPVFTFGEWFLGTNETDANNTYFANESGMSLLDFRFSQKVRQVFRDGSDTMYGLDSMLSSTAADYYSVNDQVTFLDNHDMDRFQVSGANGRKLEQALALTLTSRGVPAIYYGTEQYMTGNGDPNNRAKMSSFSTSTTAYNVISKLAPLRKSNPAIAYGTTQQRWINNDVYIYERKFGNNVAVVAINKNLTSSYSIAGLNTSLPSGTYTDVLANSLSGNSITVGSSGAVNTFTLQAGGEASGLTRRRQRLR

SEQ ID NO: 18826 - protein, 532 aa, Oryza sativa; identical to SEQ ID NO: 16831

SEQ ID NO: 18827 - protein, 338 aa, Pyrococcus furiosus DSM 3638
MIWEEILNFEPYRAVEGNYRIWLDKNESPYDLPPQLKEEILEELKRIEFNRYPHITSDPLREALAEFYGLKKENIAVGNGSDELINYLVKMFKGKYIVVTSPTFGMYSFFAKLHGIPVKDIPLKEDFTIDGERIAEEGKAASAIFIASPNNPTGNSQPENEVLKVLDSGRVVILDEAYSEFSGKSFIPKISEYENLVILRTFSKAFGLAGIRCGYMIANEKIIDALYRILPPYNLNSLTMTVAIKMLEHYDIVKRRIKLIVKERERIRREFIEYSYPSEANFLLMKLDAYDYLLKKGIVVRKLSGRLEGHIRVTIGKKWENDELIKALKEFLEECRCG

SEQ ID NO: 18828 - protein, 161 aa, Zea mays; identical to SEQ ID NO: 14438

SEQ ID NO: 18829 - protein, 332 aa, Pseudomonas syringae pv. syringae B728a
MTFERRALRADDVAIEILYCGVCHSDIHQARNEWGIAVYPLMPGHEIVGRVTATGSSATQYQVGDMVGVGCMVDSCRECSACKSDLEQYCLEGPTMTYATPDRVDGSNTMGGYSNSIVVAEHFVVRVPEKLDPAAAAPILCAGITTYSPLKHYGVKAGDKVGILGMGGLGHMGIKFAKAMGAEVTLFTRSAAKAQEAHRQGADHVIVSTDAEQMKAAAGHFDFLLDTIPVQHDLNPYLETLRFDGAHILVGLIEPIEPPVHAANLVMSRRVLAGSLIGGIAETQEVLDFCAENDITCDIEMLDIRNINEAYERMLAGDVKYRFVIDMATLKA

SEQ ID NO: 18830 - protein, 283 aa, Pyrococcus furiosus DSM 3638
MKVRKAVIPAAGLGTRMLPLTKAQPKEMLPVVRKPTIQYVLEEAYEAGIREVLIITGKHKRAIEDHFDRYEHEVKNPHLDKLDKILDDINIYYARQRVQRGLGDAIKYAEAFVGDEPFALLLGDTITLPSCTAGIIESYEELKAPVIAVEEVQEEKISLYGVVGIGRYINERIFEINKLVEKPEIHEAPSNLAILGRYILTPEIFEYLEEVKPDKKGEIQLTDALELMVQNGKKIYGYVFKGRRYDIGNIFDWLRANIELGLEDEELSEKLRELIKSLVGERI

SEQ ID NO: 18831 - protein, 348 aa, Synechocystis sp. WH 8501
MLPIRDCVQQTPCYVPGEQPQTTDYIKLNTNENPYAPPDEIFNNLEEELKKVRLYPDPVSTKLRKAAGEVFGFSHEQVLAGNGSDDILNIALRTFVNPGENVAFLDPTYSLYETIAKVHGANIQTIATNTNFELDGPLICPEAKLIFVASPNPPLGKHLNRQYLKETCEQAAGIVLIDEAYVDFSDENHWEFIQQYDNVIVSRTMSKSYSLAGMRVGLGVSSRSIIEQMNKVRDSYNLDRIAQTLATNCFQFQDYFQSIWQKVRNTRNRLTESLINLDFLVCDSDANFVLASPQWIEASQLYTKLKERKVLVRYFKHPRISNYVRITVGTDAEIDRLLEVIEQLKNEG

SEQ ID NO: 18832 - protein, 413 aa, Triticum aestivum
  unsure (1)..(413): unsure at all Xaa locations
LDPPEPARPDVRKPGCDGGIKGVRPPPVMLKPPPSMALPPAAQVGSTWDLLLSFAPEEQGQPQAIRSVPDFGDPDAEEDEDAAEVLTLEDLRLGESSEEFTGTSSISTTNDDETTESMFYISPNGRFKKKIRSWSRGVLLGSGSFGTVYEGISDEGVFFXAVKEVSLHDQGSNAQQCIFQLEQEIALLSQFEHENIVHYFGTDKEDSKLYIFLELVTQGSLVSLYQKYRLRDTHVSAYTRQILNGLNYLHERNIVHRDIKCANILVHANGSVKLADFGLAKQTSKLNVLKSCKGTVYWMAPEVVNPKKTYGPAADIWSLGCTVLEMLTRQLPYPDLEWTQALYRIGKGEPPAIPSGLSKEARDFISQCVKPNPEDRPSAAKLLDHPFVNRSMRSIRSMRTYTRPNSSTRGTSG

SEQ ID NO: 18833 - protein, 223 aa, Triticum aestivum
MGGAKKVVISAPSADAPMFVVGVNEKNYNPSMDVVSNASCTTNCLAPVAKVVHEEFGILEGLMTTVHATTATQKTVDGPSMKDWRGGRGAGQNIIPSSTGAAKAVGKVLPALNGKLTGMAFRVPTPNVSVVDLTCRLEKNASYEDVKAAIKEASEGSLKGILGYTDEDVVSNDFVGDTRSSIFDANAGMGLSSSFMKLVSWYDNEWGYSNRVLDLIGHMSLVA

SEQ ID NO: 18834 - protein, 117 aa, Buchnera aphidicola
NLFGDIISDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 18835 - protein, 468 aa, Pseudochorda nagaii
IPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNITAATMEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNSLLLTQLKINLAEGLFFDMDWASLRKCVPVASGGIHCGQMHQLLYYLGDDVVLQFGGGTIGHPDGIQSGATANRVALESMVLERNEGRDYLGQGSEILRHAATTCGPLKAALDLWKDITFDYTSTDTPDFVEVATEAQ

SEQ ID NO: 18836 - protein, 488 aa, Myelophycus cavum
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKVNLAEGLFFDMDWAALRKCVPVASGGIHCGQMHQLLYYLGDDVVLQFGGGTIGHPDGIQSGATANRVALESMVLARNEGRDYVGEGPEILRKAASSCGPLKAALDLWKDITFDYTSTDTPDFVEVATGSR

SEQ ID NO: 18837 - protein, 108 aa, Zea mays
ADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIA

SEQ ID NO: 18838 - protein, 389 aa, Coxiella burnetii RSA 493
MFEHDIVFSIFLIFAGAAVLSTFALMTRQSMLVAYMLLGILLGPWGLKLIANIDMLRTVSDVGIVFLLFLLGLNLPPQKLITMFTKIKWVALISSIVFAATGYGVAYFFNYPVVECLVIGGAMMFSSTIIGIKLLPTTILHHQHTGEVMISVLLLQDLIAIAVLFLLHGAGRQGKILVDIALVLLGFPAILIFAYLFDRFVLFPLFSKFNRIKEYLFLLAIAWCLSMAQLAASLGLSGEVGAFIAGVSLASRPVSVYISESLKPVRDFFLVLFFFSVGATFDLQFLPGVIIPALILLVLLMAIKPVIYRLLLRWVGESKQVSWEVGIRLAQISEFSLIIAYMALSNHLIANKAASLIETITILSFIVSSYWVVMKYPTPLAISDRLRRD

SEQ ID NO: 18839 - protein, 104 aa, Triticum aestivum
THLISPHILSPHISCLLSLPVAAQKTASDGTGLVTVYGTSNNGTVTQLEPKTCSFSVKVGPAQMLRGRVMMDMVNAEQARISNEAGACSVMRVERVPCDIRAQC

SEQ ID NO: 18840 - protein, 250 aa, Oryza sativa (japonica cultivar-group); identical to SEQ ID NO: 1253

SEQ ID NO: 18841 - protein, 303 aa, Fusobacterium nucleatum subsp. nucleatum ATCC 25586
MMNKKRYFGDLMLFLAAFIWGTAFVAQVTGMDRIGPFTFNMARSIIAIICLGAYLIITKSKLPKDIGVLLQGGLVCGFFIFMGTSLQQIGLQYTTAGKTGFITSFYILIIPFLTMIFLKHKIDLLTWISIIIGFIGLYLLAIPNLSDFTINRGDFIVFLGSFCWGGHILIIDYYSKKVSPVQLSFLQFVMLTILSGICALLFENETATMNNIFLSWKSIAYAGFLSSGIAYTLQMVGQKYTNPIIASLILSLEAVFAALAGYIMLDEVMTSREFLGCSIVFLAIIFSQIPKDIFKKKYVSLKK

SEQ ID NO: 18842 - protein, 166 aa, Triticum aestivum
MGGGNKQCGNDTNSRGLGGYYPSAYSSPPIAYPAYPPPQAGHGCPPAYYPPQPQGYGHGYPSAGAYGCPPSSYPHHQGGYHGHGGSLLVAGGAAAAAAYGAHHLSHGHHGHGGYYHRPAGYHHHYGGKFKKHGRYGYGYGGKFKHGKRMRLFGGKHGLFGGKHKWK

SEQ ID NO: 18843 - protein, 567 aa, Vibrio cholerae
  unsure (1)..(567): unsure at all Xaa locations
MISKNMRSHLKLSFKSIFSIKFIVISHLVKRVIYPYILAGQKRAFDFFILRNVGQNGRSHWRATMHMSKSFLIISMGFVAVSVQAQTLTRDNGAPVGDNQNSITAGEHGSVLLQDVHLIQKLQRFARERIPERVVHARGTGAHGEFVASGDFSDLTLSAPFTSKGKITPVFVRFSTVIHSKGSPETLRDPRGFATKFYTEQGNWDLVGNNLPVFFIRDSIKFPDMVHSLKPSPVTNLQDPNRFFDFFSHEPGSTHMLTWVYTNLGTPASYRTMDGFGVHAYKWINQKGDVNYVKFHWKSLQGIESLRPDEVVKVQGQDFNHLTNDLYTQINAGNHPKWDLYVQVLTPEQLSKLDYNGLDATKVWLDVPEKKVGTMTLNKVPDNFFLETEQSAFAPSNLIPGIEPSEDRLLQGRLFAYADTQLYRLGANLFQLPINRPLVEVNSHNQEGASNSAQTASDINYQPSRKLELKEDPQFKAVQTQLVGSVQQKAISNPRNFYQAGVLYRSLNEQDKQDLITNLXGXLNKVTDKEIKATMVSHFYRADKDYGTRLARATNTDLKQVAKLAAM

SEQ ID NO: 18844 - protein, 81 aa, Buchnera aphidicola
GGSAPDIAGKNIANPIAQILSIAMLVRYTMKLHKIADDIESSVIDALKKGYKTLDIANVNETHISTSDMGDVISNILNKRI

SEQ ID NO: 18845 - protein, 718 aa, Cryptococcus neoformans var. grubii
MLTRQARLLRRIPPPNAVLQSGLQRRHRSTDRYSNNIHTSSTQNAPAPVYDTPIREKGMTLEAKERVRAHVRKIQSSASTAAASPAVRPQPAQHFQAAPQPMPTNMPRFESDSQVKNGLDYSFIGLSGGQIFQEMMLRHDVKQVFGYPGGAILPVFDAIYNSPHFEFVLPRHEQGAGHMAEGYARVSGKPGVVLVTSGPGATNVITPMQDALSDGVPMVVFCGQVATNLIGSDAFQEADVVGISRSCTKWNVMVKDIAELPRRINEAFKIATTGRPGPVLVDLPKDVTAAILRTPIPAKSVQPGHSPYLPSNPLNPSSQPSDPLPGDADLITEAAQMINKAKRPIIFAGNGVLSSPEGPKLLKELSDKGRIPVTTTLQGLGAFDERDEKSLHMIGMHGSAYANFAMQEADVLIALGVRFDDRVTGKVDTFAPAAKAAAAEGRGGIIHFEIQPKNINKIVEAQIPVLGDVVASLGELVPQIEAVDRSAWIGRCKATKERYPFTYTPSQEGQKLKPQEVVQELDRQAEALGKEKFVISTGVGQHQMWACQYYRWTEPRSWVSSGGLGTMGFGLPSAIGAKVAAPEKYVIDIDGDASFSMTAMELATASQYDIGVKVLLFNNEFQGMVEQWQDLFYENRYSHTRMTNPDFVKLSESMGAKGLRCTKLEDLPRMMKEFLEYDGKRPIVLECLVSSEHVYPMIPAGKALHEQLLHPLLRNGSE

SEQ ID NO: 18846 - protein, 357 aa, Nicotiana tabacum
MGSLDVEKSAIGWAARDPSGLLSPYTYTLRNTGPEDVQVKVLYCGLCHSDLHQVKNDLGMSNYPLVPGHEVVGKVVEVGADVSKFKVGDTVGVGLLVGSCRNCGPCKREIEQYCNKKIWNCNDVYTDGKPTQGGFANSMVVDQNFVVKIPEGMAPEQAAPLLCAGITVYSPFNHFGFNQSGFRGGILGLGGVGHMGVKIAKAMGHHVTVISSSNKKRQEALEHLGADDYLVSSDTDKMQEAADSLDYIIDTVPVGHPLELYLSLLKIDGKLILIGVINTPLQFISPMVMLGRKSITGSFIGSMKETEEMLDFCKEKGVTSQIEIVKMDYINTAMERLEKNDVSYRFVVDVAGSKLDQ

SEQ ID NO: 18847 - protein, 241 aa, Lycopersicon esculentum
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 18848 - protein, 197 aa, Brassica rapa
MGRKKLEIKRMENKSSRQVTFSKRRSGLIEKARQLSVLCDASVALLVVSSSGKLYSFSAGDNLVRILDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVPLPLLN

SEQ ID NO: 18849 - protein, 594 aa, Oryza sativa (japonica cultivar-group)
MKVIEKIQEAAADGRTVFSFEYFPPKTEEGLDNLFERMDRMVAHGPNFCDITWGAGGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPEAHPDAIQSTEGATPEAYSNDLAYLKQKVDAGADLIITQLFYDTDIFLKFVNDCRQIGITCPIVPGIMPINNYKGFLRMTGFCKTKIPAEITAALEPIKDNEEAVKAYGIHLGTEMCKKILATGIKTLHLYTLNMEKSALGILMNLGLIEESKISRSLPWRPPTNVFRVKEDVRPIFWANRPKSYISRTLGWDQYPHGRWGDSRNPSYGALTDYQFTRPRGRGKKLQEEWAVPVKSVEDINERFMNFCQGKLTSSPWSELDGLQPETKIIDDQLVKINQKGFLTINSQPAVNGERSDSTSVGWGGPGGYVYQKAYLEFFCSKEKLDQLIEKSKAFPSLTYIAVNKDGESFSNIPTNAVNAVTWGVFPGKEIVQPTVVDSASFMVWKDEAFEIWSKGWACLFPEGDSSREILDKVQKSYFLVSLVDNDYINGDLFAAFKEI

SEQ ID NO: 18850 - protein, 112 aa, Petunia x hybrida
MAGKLSIILFVLLVVLLAQNQVSMAKMVLDAKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 18851 - protein, 196 aa, Mitthyridium sp. Wall 3685
GGAKKVVISAPSKDAPMFVMGVNEEKYTNEDIVSNASCTTNCLAPLAKVINDKFGILEGLMTTVHATTATQKTVDGPSNKDWPGGRSAGSNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFVKL

SEQ ID NO: 18852 - protein, 162 aa, Triticum aestivum
KKFSSVLMLRLAFQSLGVVFGDLGTSPLYVFYNAFPHGVNDDEDVIGALSLIIYTLTLIPLVKYVFVVLRANDNGQGGTLALYSLLCRHAKISTIPNQHKTDEDLTTYSRQTYEENSLAAKIKRWLETRAYKRNCLLILVLLGTCTAIGDGILTPAISVLSA

SEQ ID NO: 18853 - protein, 484 aa, Pseudomonas syringae
TDTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGIKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGALNTGHTTSGVNYEPSRLEPRPADDKARYSELPLSGTTQQAKITREQNFKQAGDLYRSYSAKEKTDLVQKFGESLADTLTESKNIMLSYLYKEDPNYGTRVAEVAKGDLSKVKSLAASLKD

SEQ ID NO: 18854 - protein, 217 aa, Triticum aestivum
GGGRHRRLLSATPLRPETGEMEGFEFFQIVLDNSSSRLRLPDKFTMVLLDGGKPQEVKLREAGHGRRFWDVKVVLDADGHMYLERGWEQFARAHDLRLGYFLVFSYDGDAVLTVKVFDVSMCRRHYKHDGDTSSESSSDGDSGSSNTSDGGSGGNNRSLVEMDVEDGPTGQFSAMLRKCNLMKQEQYPDVPGPARARVRREEQGWSCGCAASRGSCT

SEQ ID NO: 18855 - protein, 388 aa, Salmonella enterica subsp. enterica
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLK

SEQ ID NO: 18856 - protein, 467 aa, Bacillus subtilis subsp. subtilis str. 168
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 18857 - protein, 178 aa, Zea mays
MSEVFEGYERQYCEESASLSRKCTAASALDGEKKKQRLSEIQSGVQEAESLIRRMDLEARNTPPSVKAGLLAKLREYKSDLNNLKSELKRISAPNARQTTKEELLESGMADTLAVSTDQRGRLMMTTERLNQSTDRIKESRRTMLETEEPGVSILQDLHQQRQSLLHAHTTVRTCMTA

SEQ ID NO: 18858 - protein, 538 aa, Candida maltosa
MSVSFVHNVLEVVTPYVEYYQENLTKWYILIPTILLTLPFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMVPSTKNIAGREEFADAFNYSQTYNAYRFLLQQFYWILNGSKFNKSIKTVHKFADFYVQKALSLTDDDLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTISATHRDPSIYGEDANVFRPERWFEPETRKLGWAYVPFNGGPRICLGQQFALTEASYVTVRLLQEFHTLTQDANTRYPPRLQNSLTVSLCDGANIQMY

SEQ ID NO: 18859 - protein, 110 aa, Glycine max
NSARGRFLPVKATSDLLLVQWDLYTLQDGLVIRNQARANPENPSIELGPEFKKVSYFLSRFKSIPSIAELDSLTLAGDVWFGAGATLKSEGRDSTLGARKSLQRVLFFKI

SEQ ID NO: 18860 - protein, 497 aa, Oryza sativa (japonica cultivar-group); identical to SEQ ID NO: 12805

SEQ ID NO: 18861 - protein, 642 aa, Thermosynechococcus elongatus BP-1
MPTSLATAIDPKQLQQAIRASQDFLFSQQYAEGYWWAELESNVTMTAEVILLHKIWGTEQRLPLAKAEQYLRNHQRDHGGWELFYGDGGDLSTSVEAYMGLRLLGVPETDPALVKARQFILARGGISKTRIFTKLHLALIGCYDWRGIPSLPPWIMLLPEGSPFTIYEMSSWARSSTVPLLIVMDRKPVYGMDPPITLDELYSEGRANVVWELPRQGDWRDVFIGLDRVFKLFETLNIHPLREQGLKAAEEWVLERQEASGDWGGIIPAMLNSLLALRALDYAVDDPIVQRGMAAVDRFAIETETEYRVQPCVSPVWDTALVMRAMVDSGVAPDHPALVKAGEWLLSKQILDYGDWHIKNKKGRPGGWAFEFENRFYPDVDDTAVVVMALHAVTLPNENLKRRAIERAVAWIASMQCRPGGWAAFDVDNDQDWLNGIPYGDLKAMIDPNTADVTARVLEMVGRCQLAFDRVALDRALAYLRNEQEPEGCWFGRWGVNYLYGTSGVLTALSLVAPRYDRWRIRRAAEWLMQCQNADGGWGETCWSYHDPSLKGKGDSTASQTAWAIIGLLAAGDATGDYATEAIERGIAYLLETQRPDGTWHEDYFTGTGFPCHFYLKYHYYQQHFPLTALGRYARWRNLLAT

SEQ ID NO: 18862 - protein, 215 aa, Oryza sativa
MEGIEKPRILQTRRLCARIEGSFLSHILPHLWPTANDYFVWLATPTASWVAVIFTAISLHARSYGDMQAWRWPCWCSCLYRCDDGYGTLCLVQVDGMDVLAVKQACKFAKQHALENGPIILEMDTYRYHGHSMSDPGSTYRTRDEIAGIRQERDPIERVRKLLLAHDFATTQELKDMEKEIRKQVDTAIAKAKESPMPDPSELFTNVYVNDCGLE

SEQ ID NO: 18863 - protein, 325 aa, Triticum aestivum
  unsure (1)..(325): unsure at all Xaa locations
YHHSRGGSSVFLVKEVVAAAAVSDGTAGAGPGAAGLAKKKGVDPSHISADGTYALKKVLIQSDQHLELVRQEIRVSSQFSHPNLLPLLENAIIAVKGVQDGSQNHEAYLLFPVRLKWSTLRDVTXIHARKEGNTFXTITILQIFRQLCAGLKHMHSFEPPYAHNGVKPDNVLITQRKEQPHLAILMDFESARPARRAIRSQAEALQLQEWASEHCSAHFRAPELWECPPHADIDERTDVWSLGCTLYAMMYGKSPFDYELDESAGESLVTVIKSAQVKWPTETGSSYPDTLRQFVTWMLQPHPAVRPNIDDIIIHVDKLIAKHST

SEQ ID NO: 18864 - protein, 406 aa, Nicotiana plumbaginifolia
MMQQQRLKQQQQQALMQQSLYHPGLLAPPQIEPILSGNLPPGFDSSTCRSVYVGNIHPQVTEPLLQEVFASTGPLEGCKLIRKDKSSYGFVDYFDRRSAALAIVTLNGRHLFGQPIKVNWAYASAQREDTSNHYNIFVGDLSPEVTDATLFACFSVYTSCSDARVMWDQKTGRSRGFGFVSFRNQQEAQSAINDLNGKWLGSRQIRCNWAAKGAGAVGEQNSDAKSVVELTSGTSDDGQEKVVNEDAPENNPQYTTVYVGNLAPEVTSVDLHRHFHALGAGVIEDVRIQRDKGFGFVRYSSHAEAARAIQLGNARLLFGKPVKCSWGSKPTPPGSSSNPLPPPAIGQIPGLSAMDLAAYQRQLALAKMAGAQAFMQPQGQRIGAPGQGIYDGGYGGIASTQPPMYF

SEQ ID NO: 18865 - protein, 530 aa, Aspergillus niger
MLFRSLLSTAVLAVSLCTDNASAAKHGRFGQKARDAMNIANGSANAVKHSLKIPVEDYQFLNNKTKPYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 18866 - protein, 116 aa, Glycine max
NRYVECTSSALQGLALFRKLYPKHRRKEVDLCISKAIRYIEKTQNPDGSWFGCWGICYTYGTLFSVKGLTDCGKNYRNSPALRKACKFLLSKQLPNGGWGESYLSSQNKVYILLLE

SEQ ID NO: 18867 - protein, 519 aa, Escherichia coli K12
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANPEVLHALNPMWAVHFFLEYKTVSFIALGAVVLSITGVEALYADMGHFGKFPIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVDSVNSAHRRRSICP

SEQ ID NO: 18868 - protein, 176 aa, Triticum aestivum
MGGGNDGHGYPPGGQGGYPPAGYPPQQGGYPPQQGAYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGGGMGMGGMLAGGAAAAAAAYGAHKISHG

SEQ ID NO: 18869 - protein, 396 aa, Helianthus annuus
  unsure (1)..(396): unsure at all Xaa locations
MAXRINPATFQSDMYRSFAFPQPKPLRSPKFAMASTIGSATTKVESTKKPFTPPREVHQQVLHSMPPQKIEIFKSMEGWAEDNILVHLKPVEKCWQAQDFLPDPASDGFMEQVEELRARAKEIPDDYFVVLVGDMITEEALPTYQTMLNTLDGVRDETGASPTSWAIWTRAWTAEENRHGDLLHQYLYLSGRVDMRQIQKTIQYLIGSGMDPRTENSPYLGFIYTSFQERATFISHGNTARHAKEHGDVKLAQMCGIIAADEKRHETAYTKIVEKLFEIDPDGTVLAFADMMRKKISMPAHLMYDGRDDNLFENXSAVAQRLGVYTAKDYADILEFXVGRWKVADLTGLSGEGRKAQDYVCGLAPRIKRLEERNSARAKERVNVPFSWXLDREVKL

SEQ ID NO: 18870 - protein, 605 aa, Desulfovibrio desulfuricans G20
MSRSRSRDHAAEARPSAGKAAMHGSKTQCPAPEKQQPAARPERMTGAAAVVRMLERQGVRHVAGIPGGASLPLYDALAARGSIRHILTRHEQAAGFIAQGMARATGVPAVCLATSGPGATNILTALADAKLDSVPVVCITGQVPTTLIGTDAFQEVDTYGMSIPVTKHNFLVRTAQELLSVIPEAFRIAASGRPGPVLVDIPRDVQLATLEIDSWPGPGLPDAPLMPDMEDVVGAAAMIDEAERPLMYLGGGVISSGAAPAARRIAEKAGIPVAMTLMGLGAVPSEHPLSLGMLGMHAARCTNMAMEECDLLIVAGARFDDRATGRVDSFCPRARVIHIDIDASELDKIRSAHLGIQGDVRATLEALEPLVAPCARENWLHRVEELRNGWGLDLPRTDDPVSPYGMILRTAEIVGPEAVVTTDVGQHQMRTAQAYPFSRPRQWLTSGGLGTMGFGLPAAIGAALACPERTVVCFTGDGSLQMNIQELATAVEQRCNIKIILANNNALGLVQQLQNLFFERRVFATDYSVQVDFVRIAEGFGMPAVDLGASRDPLGMLEAALTTAGPCLVNIPVAVSESVFPMVPPGAANTEMIEGDGHDRTEAAA

SEQ ID NO: 18871 - protein, 258 aa, Oryza sativa
  unsure (1)..(258): unsure at all Xaa locations
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGNHTMEXVLQRKLKAIAEKISDWTNVVLAYEPVWAIGTGXKVATPAQAQEVHDGLRKWLVTNVSPAVAESTRIIYRGSVNGANCKELAAKPDVDGFLVGGASLKPEFVDIIKSATVKSSA

SEQ ID NO: 18872 - protein, 223 aa, Vibrio cholerae
AGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDV

SEQ ID NO: 18873 - protein, 486 aa, Solanum tuberosum
MGLVSENYNKKLLSKIATNDGHGENSAYFDGWKAYENDPFHPTQNPHGVIQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFSQPSFISISEVMSEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLEKSTFDDELKLWHIIINKVKLNVSPGCSFHCSEPGWFRVCFANMDDATMQVALKRIRHFVYLQPSKGVEVATKKQYCRTRSKLEISLSFRRLDDFMNSPHSPMSSPMVQARN

SEQ ID NO: 18874 - protein, 201 aa, Glycine max
  unsure (1)..(201): unsure at all Xaa locations
MVLEATMICIDNSEWMRNGDYSPSRFQAQTDAVNLICGAKTQSNPENTVGVLTMAGKGVRVLVTPTSDLGKILACMHGLEIGGEMNLAAGIQVAQLALKHRQNKKQQQRIIVFAGGPVKHEKKMLEMIGRKLKKNSVALDVVNFGEEDEGKTEXLEALLSAVNNNDTSHIVHVPSGPNALSDVLISTPIFTGDXEGESGFA

SEQ ID NO: 18875 - protein, 611 aa, Zymomonas mobilis
MTIIAIGSWGFEKEIKHVSPTQRAAIVLETLKDMGVDLIFGYPGGAVLPIYDALYQDEGIRHILARQEGGAVHAAEGYARSTGKPGVVIVTSGPGATNAVTGIADAMLDSIPLVVFSGQVATNLIGTDAFQEADTIGITRHCTKHNYLVRDPKEFSSDDCRGLPSGTSGRPGPVVIDLPKNVQTAVIDYIKPDPNKRMHRGYRPRVKADPVEITNALDMIAKAKRPVFYTGGGVINSGPDASKALRELADLTGVPVTSTLMGLGAFPASSQQWLGMLGMHGTYEANFAMHDADLVVALGSRFDDRVTCRVDSFSPHSKKIHVDIDRSSINRIIHVDLPIVGDVGSVMQDMVALWKEKHYQMQDISAWWVQIDEWRAKQCLNFTKQGNEIMPQQAIRSLWEATKGKNPIVSTEVGQHQMWTAQYFGFDSPNHFLTSGGLGTMGYGFPSIIGAQVGNPDSLCMTIAGEASFQMNIQEMATVAQYRLPVKIFILNNRFMGMVRQWQDLLYDHRRSQSYSEALPDFVALAKAYGWNALKIEKPSQLEDGIKTMLETPGPVLVDCQVAQLANCLPMVPPGAGQTEMILESDITDNHVKKPEYTPSAAPSSATTIRG

SEQ ID NO: 18876 - protein, 398 aa, Lactobacillus plantarum
MGEHMDFLGILCLLILATTLAGHFAHRAGIPAVIGEILVGVILGPALLNWVHLTTLVQTFSDIGVVVLMFIGGLESNLALLRKYLPPAIIVGIIGVIFPVVIMGLASRFFQFSWFESLFIGVIFSATSVSISVEVLKEFKVLDTKEGATILGAAVADNIIGVILLSIMIAMMGGQSGVAQTNLGNVLLEQVGFFIGVFIVIKWVAPYLMRLSDHLLMAASPTIMAIIICLALAWLAKLVGLSGAIGAFFAGVAIAQTDYQHVVDVSIEPVGYTTFIPLFFVSVGLNMTFKGVWQSLTFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIEEH

SEQ ID NO: 18877 - protein, 506 aa, Arabidopsis thaliana
MVENLFPSRFQFHLQRLDPKRRLTSLLASHKTLFTFLWITAFGSVFLWQRTAYIEGGSGTGPVGGKFTIFGKIKPIQPIPRLRPVVFDLKDFGGVGDGFTLNTEAFERAVISISKLGGSSGGGQLNVPPGRWLTAPFNLTSHMTLFLAEDSEILGVEDEKYWPLMPPLPSYGYGRERPGPRYGSLIHGQNLKDIVITGHNGTINGQGQSWWKKHQRRLLNYTRGPLVQIMWSSDIVIANITMRDSPFWTLHPYDCKNVTIRNVTILAPVTGAPNTDGIDPDSCEDMVIEDCYISTGDDAIAIKSGWDQFGIAYGRPSTNILIRNLVVRSVISAGVSIGSEMSGGISNVTIENLLIWNSRRGIRIKTAPGRGGYIRNITYKNLTLDNVRVGIVIKTDYNEHADDNYDRKAYPILSGFSFAGIHGQGVRVPVRIHGSEQIPVRNVTFRDMSVGLTYKKKHIFQCSFVKGRVFGSIFPRPCENFDVYDEEGRLVKPAAESNVADIDYDI

SEQ ID NO: 18878 - protein, 95 aa, Agaricus bisporus
RAAARAGTTIGKEAHFREALAYFSEWRHLRLIMGTASCWFLLDIAFYGINLNQNVVLQQIGFDGSSGSAWNRLFKISTGNIIITALGFVPRPRPR

SEQ ID NO: 18879 - protein, 204 aa, Glycine max
KTLTCESLVGVFVPFVVEERVTHRERSSYFGRRTVKPESFSFLDDEPDIFAARPGLEPFGTARFYRHVPHPSPDGLAEIMIIRGRIMMGGRFDSHDQFRDWRLDVDNMSYEQLLELGERIGYVNTGLKEDEMGLNIRKVKPSSSNDTSKHQLDKKCSVCQEEYESDDELGRLKCDHSYHFQCIKHWLEHKNFCPVCKQEVVVRH

SEQ ID NO: 18880 - protein, 106 aa, Brassica tournefortii
GVETVFAYPGGASMEIHQALTRSSTIRNVLPRHEQGGVFAAEGYARSSGKPGICIATSGPGATNLVSGLADAMLDSVPLVAITGQVARRMIGTDAFQETPIVEVTR

SEQ ID NO: 18881 - protein, 573 aa, Triticum aestivum
NSSDLEASACCKHFTAYDLENWKGVTRFAFDAKVTEQDLADTYNPPFKSCVEDGGASGIMCSYNRVNGVPTCADHNLLSKTARGDWSFNGYITSDCDAVAIIHDVQGYAKAPEDAVADVLKAGMDVNCGGYIQTHGVSAYQQGKITGEDIDRALRNLFAIRMRLGLFNGNPKYNRYGNIGADQVCKKEHQDLALQAAQDGIVLLKNDAGALPLSKSKVSSVAVIGPNGNNASLLLGNYFGPPCISVTPFQALQGYVKDATFVQGCNAAVCNVSNIGEAVHAASSADYVVLFMGLDQNQEREEVDRLELGLPGMQESLVNKVADAAKKPVILVLLCGGPVDVTFAKNNPKIGAIVWAGYPGQAGGIAIAQVLFGEHNPGGRLPVTWYPKEFTAVPMTDMRMRADPSTGYPGRTYRFYKGKTVYNFGYGLSYSKYSHRFASEGTKPPSMSGIEGLKATASAAGTVSYDVEEMGAEACDRLRFPAVVRVQNHGPMDGRHPVLLFLRWPNATDGRPASQLIGFQSVHLRADEAAHVEFEVSPCKHFSRAAEDGRKVIDQGSHFVKVGDDEFELSFMA

SEQ ID NO: 18882 - protein, 187 aa, Escherichia coli CFT073
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGVGVFKGLANPLTVTRYHSLVVEPDSLPECFEVTAWSETREIMGIRHRQWDLEGVQFHPESILSEQGHQLLANFLHR

SEQ ID NO: 18883 - protein, 412 aa, Neurospora crassa
MSTKLCQRIARTATLSPTSLVPRSSRLIPIVSSAAVRPSSAIPTRRPFSTTESRYLANVQAGMDKIRDAIAENFGGPAHNIGTTSFSLDDTPDLSGKVAVITGGSEGIGYGVAYTLIKHNLSKLFILSRKREVFDGALASIASELGQDKADRVHWIQCNLEDWAQTAVVAEQIKKDTDRLDILVNNSGRGIMTAGLTSYGVDKHMATNHMGHVVLTSHLLPLLQKTAEETGETVRISNQSSNLHSAAPKGTQFKSLEEINEDVGPNGQYGRSKLAGILYARYFDREVTRKMEGSKGRVVMNATHPGFVSTKQSVKDIHEPYPISGFAISHLAEPFKKDQFEGAVPTVYAVTMANEGGQWICAPAKAEAGTDLAQSDELADNLMELTRKIISEKTWPKSVAKGCPMDDVVVHV

SEQ ID NO: 18884 - protein, 519 aa, Glycine max
  unsure (1)..(519): unsure at all Xaa locations
MFIESFKVESPNVKYTETEIQSVYNYETTELVHENNNGTYQWVVKPKTVKYEFKTNTHVPKLGVMLVGWGGNNGSTLTGGVIANXREGISWATKDKIQQANYFGSLTQASAIRVGSFQGEEIYAPFKSLLPMVNPDDVVFGGWDISNLNLADAMARAKGXDIDLQKQLRPYMESMVPLPGIYDPDFIAANQGDRATNVIRGTKKEQVQQIIKDIXKEFKESTKVDKVVVLWTAXTERYSNVVVXGLNDTMENLFASLDRNEAEISPSTLYAIACVMENVPFINGSPQXNTFVPGLIDLAIKRNSLIGGDDFKSGQTKMKSVLVDFLVGAGIKPTSIVSYNHLGNNDGMNLSAPQTXFRSKEISKSNVVDDMVNSNXILYEPGEHPDHVXVVIKYVPYVGDSXRGPMDEYSSEIFMGGKNTIXVLHNTCEDSLLAAPIILDLVLLAELSTRIEFKAENEGKFHSFHPVATILSYLTXKAPLVPPSTPVVNALSKQRAMLENILRACVGLAPENNMILEYK

SEQ ID NO: 18885 - protein, 491 aa, Archaeoglobus fulgidus DSM 4304
MVRRLRGDCMEEVERAKAVLKENNVRQVLCAFADVRGYLQMFSIPAREFVDGSAFENGIGFDGSSVRGFRTIEKSDMVWMPDASSLKIIPWIDDPIQKSAIMFGNVYEAWGTEIADCDPRGYVAKRYEDMLKSEGMSAIFGPEIEFFLFEGVDFTRLSWDMWVSPNGGAGDSWGPPRIMPISSELESGYMIRPKEGYFRPPPEDTTVEYRNELVYYLEQLGIDIEYHHHEVATAGQVELDFKPKQLVDVGDAFYLYKFAAKNIAAMHGLYATFMPKPLYLDNASGMHTHQSLWKGEPFSGEAVFADPDDEYMLSQKARYYIGGLLEHAKALTALCAPTVNSYKRLVPGFEAPIYICWSPRNRSALVRVPMYVKKPSAIRVEYRGVDPSCNPYLAITAQLAAGLDGIKKKIDPGDPLLEDVYELTPAQKRELGVGELPTTLRDAIDHLASDELMQEVLGSHIFDAFMELKIDEWNQYCLYITPWEFMKYFDI

SEQ ID NO: 18886 - protein, 572 aa, Shigella flexneri 2a str. 301
MKQTVAAYIAKTLESAGVKRIWGVTGDSLNGLSDSLNRMGTIEWMSTRHEEVAAFAAGAEAQLSGELAVCAGSCGPGNLHLINGLFDCHRNNVPVLAIAAHIPSSEIGSGYFQETHPQELFRECSHYCELVSSPEQIPQVLAIAMRKAVLNRGVSVVVLPGDVALKPAPEGATTHWYHAPQPVVMPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKTDRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIIVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 18887 - protein, 337 aa, Nostoc sp. PCC 7120
MIRVAINGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDANLTLVMGNDLVKVMAWYDNEWGYSQRVLDLAELVAEKWV

SEQ ID NO: 18888 - protein, 176 aa, Borrelia burgdorferi B31
MKNKTEYYDQFISKIPNFPKKGVLFYDITSVLLKPEVYSSLINEVYSFYNFKKIDCIAVVESRGYLIGAPLSLKMQLPLVLIRKEGKLPREVFSEEYELEYGFGRIEVHKDDVRTYSNILLIDDILATGGTLKSSAILLERAGGKVKDIFCFIELCAINGRQSLESYEVNSLVRYN

SEQ ID NO: 18889 - protein, 336 aa, Staphylococcus aureus subsp. aureus Mu50
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKQDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 18890 - protein, 163 aa, Triticum aestivum
  unsure (1)..(163): unsure at all Xaa locations
PGXSTGATMSDDEDNQVDSETNMFDGNDGSDGMGFGPLILTEGERSLIERVRHELKSELKQGYKEKLVDIREEIMRKRRAGKLPGDTAATLKAWWQAHSKWPYPTEDDKARLVQETGLQLKQINNWFINQRKRNWHSSNTASSSEKTKKKRNVTGNDGTEQSW

SEQ ID NO: 18891 - protein, 216 aa, Thermoanaerobacter tengcongensis
MKIAPSILSADFANLLQDVKEIEEDADLLHIDVMDGHFVPNITIGSVVVKALRQYTSLPFDVHLMIENPDLYIEDFVKAGADIITVHQEACVHLHRTIQRIKGHEVKAGVALNPATPLETLKYILEYVDLVLVMTVNPGFGGQKFIDSMLKKIKELDEMRKEMNLSFEIEVDGGINIKNIKQVVEAGADIIVAGSAIFESPDPSSTIKEFREAVGT

SEQ ID NO: 18892 - protein, 246 aa, Oryza sativa; identical to SEQ ID NO: 14948

SEQ ID NO: 18893 - protein, 505 aa, Ralstonia metallidurans
MAAARSRPGRPAIGWWKCRSTMPRPSPISTRSTNCTCTKARSARVRLPAYAQDLAFRVHARRPLFLFRLSRAPPDYAMPSLQSVISCLSDYDPSALPVAKANAIIGDVIEPVGGIEQLAIRTALDRVLAEDVISSIDVPAHDNSAMDGYAFSSAALADAGSDVVLQVIGTAYAGNALGSPAGPGQAVRIMTGAVMPDGCDTVVPQEFVEIQAGGNQIRFAADAVRAGDNRRLRGEDLASGQAALAAGRILQPADIGLLASLGVAEVKVRRRLRVAFFSTGDELRSIGEVLDPGCVYDSNRYTLHGMLRRLNVDLIDMGVVRDDPEALEAAFRSACENADAIITSGGVSVGEADYTKQIMAQLGDVTFWKIAMRPGRPMAFGRITSNGREALLFGLPGNPVAVMVTFYHFVRAALHRLMGAKVAPLPLMRVRSAGTIRKKPGRTEYQRGILAPGADGTLEVRVTGQQGSGVLRSMSEANCFIVLAHEQGTVEAGESVEIMLFDGLI

SEQ ID NO: 18894 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 18895 - protein, 362 aa, Candida albicans
SPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPLNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 18896 - protein, 135 aa, Haemophilus influenzae
EDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 18897 - protein, 164 aa, Zea mays
MADDGGSHEGSGGGGGVREQDRFPPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 18898 - protein, 446 aa, Triticum aestivum
MAATIQSVKARQIFDSRGNPTVEVDVCCSDGTFARAAVPSGASTGVYEALELRDGGSDYLGKGVSKAVDNVNLIIAPALIGKDPTAQTELDNFMVQQLDGTKNEWGWCKQKLGANAILAVSLAICKAGASIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 18899 - protein, 144 aa, Oryza sativa
MAEEGQRGGYSRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGWFLYCGNY

SEQ ID NO: 18900 - protein, 422 aa, Oryza sativa
MAMTAAAVTVPLGVLLRREVTSERMERPDVLCGEAARSRKGEDFTLLLAEAGERVAGDPSTSFSVFALFDGHNGSGAAMYAKKNLLNNLLRAIPSGLSRDEWLAVLPRALVAAFVKTDKDFQAVAETSGTTVTFVVIDEWVVTVASVGDSRCILESADGSLYHLSADHRFDSNQDEVQRVTACGSKVGKLNLVGGPEVGPLRCWPGGLCLSRSIGDMDVGECIIPVPHVKQVKLSNAGGRIIIASDGVWDDLTFEMALECSRGFPSDIAANRIVNEAIHPRGLRDDTTCIVVDILPPEKLAPSPPTKRQGKIVFNNMFRRKHTDVSFILDREYAEPDEVEEIFDDGSAMLSKRLAAGYALQSMFEPFSCAVCQVQLKAGQGISVHSNPLQHEKLQGWQGPFLCQSCNEKKDAIEGKRPPRDS

SEQ ID NO: 18901 - protein, 563 aa, Zygosaccharomyces bisporus
  unsure (1)..(563): unsure at all Xaa locations
MSEITLGRYLFERLRQVDTNTIFGVPGDFNLSLLDKIYEVQGLRWAGNANELNAAYAADGYARVKGMAALVTTFGVGELSALNGIAGSYAEHVGVLHIEGVPSISSQAKQLLLHHTLGNGDFTVFHRMSANISETTAWLTDITTAPAEIDRCIRVTYLTQRPVYLGLPANLTDQKVPASLLNTPIDLSLKENDPEAEAEVVETVLELIKEAKNPIILADACCSRXDVKAETKKLIDITQFPSFVTPMGKGSIDEQNPRFGGVYVGTLSSPAVKKAVESADLVLSVGALLSDFNTGSFSYSYKTKNVVEFHSDHIKIRNATFPGVQMKFVLEDLLKKVPAAVKGYNPGPVPPAPSPNAEVAASTPLKQEWLWRQVGKFLQEGDIVITETGTSAFGINQSHFPNRTYGISQVLWGSIGYTTGSTLGAAFAAEEIDPKKRVVLFIGDGSLQLTVQEISTMVRWGLKPYLFVLNNDGYTIERLIHGEKAQYNDIQPWKNLELLHAFGATDYETHRVATVGDWDKLTTDSKFNENSRIRMIEVMLETMDAPSSLVAQAQLTAAINAKQ

SEQ ID NO: 18902 - protein, 337 aa, Zea mays; identical to SEQ ID NO: 717

SEQ ID NO: 18903 - protein, 175 aa, Oryza sativa; identical to SEQ ID NO: 3706

SEQ ID NO: 18904 - protein, 239 aa, Bacillus subtilis
MKRVLLILVTGLFMSLCGITSSVSAQTGGSFFEPFNSYNSGLWQKADGYSNGDMFNSTWRADNVSMTSSGEMRLALTSPSYNKFDCGENRSVQTYGYGLYEVRMKPAKNTGIVSSFFTYTGPTEGTPWDEIDIEFLGKDTTKVQFNYYTNGAENHEKLADLGFDAANAYHTYAFDWQPNSIKWYVDWQLKHTATTQIPTAPGKIMMNLWNGTGVSDWLGSYNGVNPLYAHYDWVRYTKK

SEQ ID NO: 18905 - protein, 534 aa, Oryza sativa (japonica cultivar-group)
MGGGGGEQQQLEVLHALDVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFLRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVANNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVALIDVVGPFQDPAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 18906 - protein, 240 aa, Pisum sativum
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGTMSLKELQSLEQQLDTALKLIRTRRNQLMYESISELQKKEKVIQEQNNMLAKKIKEKEKIAAEQQVQWEHPNHHGVNPNYLLHQQLPSLNMGGNYREEAPEMGRNELDLTLEPLYTCHLGCF

SEQ ID NO: 18907 - protein, 238 aa, Zea mays
MDPTKFRPSSSHDTTVTTTNAGAPVWNDNEALDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 18908 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 18909 - protein, 418 aa, Prionitis schmitziana
DTDVLALFRVTPQPGVDPVEASAAVAGESSTATWTVVWTDLLTACDLYRAKAYKVDAVPNSTEQYFAYISYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVTEGPQILQDAAKT

SEQ ID NO: 18910 - protein, 298 aa, Ustilago maydis
MDKYQRIEKVGEGTYGVVYKAKDLTPGANGRIVALKKIRLETEDEGVPSTAIREISLLKELRDDNIVRLFDIVHQESRLYLVFEFLDLDLRKYMDHVSRNRGGDGMGPEIVRKFTYQLIRGLYYCHAHRILHRDLKPQNLLIDREGNLKLADFGLARAFGIPLRTYTHEVVTLWYRAPEVLLGSRHYSTAIDMWSVGCIFAEMTLGHPLFPGDSEIDQIFKIFRALGTPTDDVWPGVQQLPDYKDSFPKWAGRPLRDAVPGLDEAGLDLLEGMLVYDPAGRTSAKRSLVHPYFRRLLT

SEQ ID NO: 18911 - protein, 189 aa, Thiocapsa roseopersicina
MIDLITQLIRPDIRALSAYHVPDPAGLIKLDAMENPYGWPDTLKAEWLEGMHDLALNRYPDPQGTAVQAALRQAMGIPSDMGLLLGNGSDELIQMLAIAVAQPGRKVLSLDPGFVMYRMIACFAGMDYVGVPLRSDDFSIDLPVMLDAIEREQPALIYLAYPNNPTGNRFDSDDMVRIIEAAPGLVIVD

SEQ ID NO: 18912 - protein, 305 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAQRGNDSAAMSTRTGK

SEQ ID NO: 18913 - protein, 140 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 18914 - protein, 633 aa, Clostridium perfringens str. 13
MNKDLLFTIPKKYHNKESLISIFEDHPEIKFVSLVGVDLAGNDTDEKIPSKLFLKDIDSFLHGTAVQTDGSSVVLPGIATLNNAKVDMIADLDCKWFVDYNYDFIDPLTNRPVGTLRIPCFLIHEDKAVDSRHILKNSIDTFKSNIFSLLKKYPETLNDLNIKFDDIDDLLLTSATELEFWVKTPNDKALIEELSTSEVLQEQYWTRTKGNVRTALEQSLLYMDEYGFEPEMGHKEVGGVKAKLTSSGQFDHIMEQLEIDWKFSDAMQAADNELFIRTLVKETFRRNGLEVTFLAKPISGVAGSGEHTHLSLSLKLKDGRMINLFNPTKNHFLSKIGYGSIMGILKNYEVMNPFISATTDSLKRLKPGFEAPVCIVTSLGQSPEVPSRNRTILAGLIRDPHNPLATRFELRSPNPFTNTYLCIASSYMAMLDGIKYALENDKTEDDLLAELSKKPGEEADYLEKSRAYRSEEDVFEDFTDSQRDEYFGVAPATVFENLSAFDKYPEKVDVLKVNSVFTDKLINSFKMATTKRWTTEITSRIIPSYTKDIRAAKQLHCCDKALDLDVSTWMTINELRHITMKDSYHRRSLFTQIKNAINESDFEKASDLQIKLDKNMSELNDLYSTYKKNLLDI

SEQ ID NO: 18915 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELGSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 18916 - protein, 615 aa, Zea mays
MRQSHSLSPSSSPPRPLDLISSILACSPLPVSPPPATPMSQSSPLFSVARAHAGAGGRAVAAALLLRRRPIAQLPHSIHGLRCLSPARATPSKTLLSLPRATLSSFADPDGDGGSSAKASDGGAKAGAGGEEQVGECEMSEMARAFHISPRVATSISVTIAFAALTVPLAMRSLVCHGTFRMNALAYFTLLSGFYMAWNIGANDVANAMGTSVGSGALTLRQAVLTAAVLEFSGAFLMGTHVTSTMQKGILVASAFQGKDSLLFAGLISSLAAAGTWLQVASSYGWPVSTTHCIVGAMVGFGLVYGGVDAVFWSSLARVSSSWVISPLMGAAVSFLVYKCIRRFVYSAPNPGQAAAAAAPIAVFTGVTAISFAAFPLSKVFSIAILQAVSSGAIGAIIVSRVIQKQLGDLLSSEAEKIASAEKSSAQQAGFLSDIAGPTGAQLQIVYGVFGYMQVLSACFMSFAHGGNDVSNAIGPLAAALSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVASWLVTIPVGAVLSIFYTLILTKILAYFM

SEQ ID NO: 18917 - protein, 280 aa, Phaseolus vulgaris
GEGTYGVVYKARDRVTNEAIALKKIRLEQEDEGVPSTAIREISLLKEMQHRNIVRLQDVVHSGKRLYLVFEYLDLDLKKHMDSSPEFAKDLRQVKMFLYQILCGIAYCHSHRVLHRDLKPQNLLIDRSTNSLKLADFGLARAFGIPVRTFTHEVVTLWYRAPEILLGSPRYSTPVDIWSVGCIFAEMVNQRPLFPGDSEIDELFKIFRILGTPNEDTWPGVTSLPDFKSAFPKWQPKDLKTVVPNLDPAGLDLLSRMLHLDPSKRITGRSALEHEYSERH

SEQ ID NO: 18918 - protein, 285 aa, Arabidopsis thaliana
LKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGR

SEQ ID NO: 18919 - protein, 532 aa, Wolbachia endosymbiont of Drosophila melanogaster
MPILQADNVEKIKFDSSLCKEQEKLFYYKFNIIPWQKLNDTTFFMVEDTSRDINRWVEAHYGIDYVLIKVDSEQILNLLNSHFGISEFASNYLYYKNPNFSAKSIKLSSIFFASFFIVTSILTLTEKYTYFALMLIFIIGCSSYLFKFIATVFSLCETSNQKVDYSKLNEEDFPIYTILLPAFKESAVIEQLIESIESLDYPKSKLDVKLQVESDDQETLAAIEKYTLPQYFEVIKVPHSLPRTKAKSCNYAMSFARGKYAVIYDADDKPDPLQLKKALIEFNKDDDKLACVQAKLNYYNCDYNFLTKFFSLEYMNWFQYLLPGFQKMNMPIPLGGSSNHFSVKILKEVFFWDTYSVTEDADLGLRLAQMGYKTRMIDSETLEESPIAVFAWIKQRARWIKGYMQTYIVHLKNIKSLYKHTGFKGILLLNLFVGSAAFIFFTTPFLLLSLILTKVLNELFLYYFVVVYVTNLILLVIAVKQQKMPFYFYIVSIFFPVYSLLHSVAAFLALWEFILYPERWNKTQHGLWKQNL

SEQ ID NO: 18920 - protein, 481 aa, Rhodobacter sphaeroides
MTDFRREKILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKYTAMGGLGR

SEQ ID NO: 18921 - protein, 255 aa, Coxiella burnetii RSA 493
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 18922 - protein, 487 aa, Arabidopsis thaliana
MFGSTLDSSRGNSAASGQLLTPTRFVWPYGGRRVFLSGSFTRWTEHVPMSPLEGCPTVFQVICNLTPGYHQYKFFVDGEWRHDEHQPFVSGNGGVVNTIFITGPDMVPAGFSPETLGRSNMDVDDVFLRTADPSQEAVPRMSGVDLELSRHRISVLLSTRTAYELLPESGKVIALDVNLPVKQAFHILYEQGIPLAPLWDFGKGQFVGVLGPLDFILILRELGTHGSNLTEEELETHTIAAWKEGKAHISRQYDGSGRPYPRPLVQVGPYDNLKDVALKILQNKVAAVPVIYSSLQDGSYPQLLHLASLSGILKCICRYFRHSSSSLPILQQPICSIPLGTWVPRIGESSSKPLATLRPHASLGSALALLVQAEVSSIPVVDDNDSLIDIYSRSDITALAKDKAYAQIHLDDMTVHQALQLGQDASPPYGIFNGQRCHMCLRSDSLVKVMERLANPGVRRLVIVEAGSKRVEGIISLSDVFQFLLGL

SEQ ID NO: 18923 - protein, 477 aa, Ahnfeltiopsis paradoxa
KNERYESGVIPYAKMGYWDPDYVVKDTDVLALFRVSPQPGVDPIEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRAIAGAGEVKGHYLNVTAATMEDMYERAEFAKQLGSIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 18924 - protein, 361 aa, Arabidopsis thaliana
MALEEEEESQNAPFCVLDGLFCEEESEFHEQVDLCDESVEKFPFLNLGLSDHDMLWDDDELSTLISKQEPCLYDEILDDEFLVLCREKALDWIFKVKSHYGFNSLTALLAVNYFDRFITSRKFQTDKPWMSQLTALACLSLAAKVEEIRVPFLLDFQVEEARYVFEAKTIQRMELLVLSTLDWRMHPVTPISFFDHIIRRYSFKSHHQLEFLSRCESLLLSIIPDSRFLSFSPSVLATAIMVSVIRDLKMCDEAVYQSQLMTLLKVDSEKVNKCYELVLDHSPSKKRMMNWMQQPASPIGVFDASFSSDSSNESWVVSASASVSSSPSSEPLLKRRRVQEQQMRLSSINRMFFDVLSSSPR

SEQ ID NO: 18925 - protein, 155 aa, Synechocystis sp. WH 8501
RSPDAVTLIGEEGIELNPNLSDSIKTELAWASVMLLKNTVTQSLVVYYQDQVLLRRGILGESSQVTPGKILKRVLEKQKAVYLVNLTLYPGKIEFDYLPPNTQGVICQPLGSNGAIILGANVPRSYTKQDENWIEGIADKLTLTLESELNPTKLQ

SEQ ID NO: 18926 - protein, 312 aa, Pseudomonas syringae pv. tomato str. DC3000
MFLVCGEALFDIFTRADDGGSLNRLGFDAIAGGSPFNVAIGLRRLGVEAAFFAGLSTDYLGRRLRAVLEQETVNAEHLIEFDAPTTLAMVAVGSDGSPTYSFRGDGCADRQLRLEHLPELDERVRGIHVGSFSLVVQPIADTLLALVARESARRLISLDPNVRLNPAPDIQRWRTQIAAFAEHAHLIKVSDEDLHLLYPDSDPQQIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 18927 - protein, 246 aa, Chrysanthemum x morifolium
MGKGRLELKRIENKINRQVTFAKRRNGLLKKAYELSVLCDAEVALIIFSTRGKLYEFSSTSSMLKTLERYEKSSFGPPEQRRPAKEDLQEQSSYQEYMRLKERYDALKQLERNYYGEEIDNLSTNELESLERQLHCSLKQIRTIRTQSLVDRLYEQQKMEHHLYESNKTLRLKFEEESQAEALQWEAHARANGMVYGHPQHQLSQTTHDAFYHPTGCETTLQIGYQTDMSAVTSTSMNHQMQGWPA

SEQ ID NO: 18928 - protein, 95 aa, Brassica oleracea
LQLEEPRGTLRNKHQNITYGSSGSQYNNNGSINHNAYNPSMETDFVPEQTAPDTTVSHPKTHKGKTAQLPEPLIQILSPMDREARVLRYREKKKR

SEQ ID NO: 18929 - protein, 295 aa, Triticum aestivum
  unsure (1)..(295): unsure at all Xaa locations
MNLAAPISTSTSTSTSTAVRPHAHGLMPLNLPSAASSSLRRSIFASLRKKISPMASAPASASAALSTAAPADNGAAKPTEQRPVQVAKRLEKFKTTIFTQMSMLAVKHGAINLGQGFPNFDGPDFVKEAAIEAIKAGKNQYARGYGVPELNSAVAERFLKDSGLQIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCXENDVLLFADEVYDKLAFEADHISM

SEQ ID NO: 18930 - protein, 494 aa, Pseudomonas fluorescens PfO-1
MQNPERPVGFFLREGTPDGPDAIAFLAKVVPMSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRRKMENRGAAVLN

SEQ ID NO: 18931 - protein, 714 aa, Lycopersicon esculentum
MALMRLLTQVERQQSQLRHISSLFNRTYLSSGRIIGSEVHGVANTKQRFQSSYVGSLARRVREREETSNASFHRSDPEAVIRSFESQPSLHSNPAAVSEYVKALVKADRLDESELLRTLQRGIAGSARSHMEEENIGALSALRNVGKSTKDGVLGTRNTPIHMVAVEGGNFKEQLWRTFRSLAVAFLLISGVGALIEDRGISKGIRGLGLNEEVQPTMETNTRFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMRMTLNQLLVELDGFKQNDGIIVIAATNFAESLDKALVRPGRFDRNIVVPNPDVEGRKQILESHMSKILKADDVDLMIIARGTPGFSGADLANLVNIAAVKAAMDGAKAVSLADLEHAKDKIMMGSERKSAFISQESRKLTAYHEGGHALVAIHTDGALPVHKATIVPRGMALGMVAQLPEKDETSISRKQMLARLDVAMGGRVAEELIFGESEVTSGPSDDLKQATKLARTMVTKFGMSKEVGLVTHNYDDNGKSMSTETRLLIEKEVRELLERAYNNAKTILTTHNKELHALANALLEKETLTGGQIKALLAQVKSQQTQQKQHQSVSVESTPQSNPRPPQSPSAAAAAAAAAAAAAATAAAKTKGIAPVGS

SEQ ID NO: 18932 - protein, 492 aa, Capsicum annuum
MDLSKYRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHTRGSPESIRDILGFAVKFYTREGNFDLVGNNVPVFFNRDTKSFPDTIRALKPNPKSHIQENWRILDFFSFLPESLHTFAFFYDDVCLPTDYRHMEGFGVHAYQLINKAGKAHYVKFHWKPTCGVKSMTEEEAIRVGGTNHSHATKDLYDSIAAGNYPEWKLFIQIMNPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRSWAPDRQDRYINKWVESLSDPRVTHEIRSIWISYLSQADKSCGQKVASRLTVKPTM

SEQ ID NO: 18933 - protein, 127 aa, Synechocystis sp. PCC 6803
MLALIDTVKSIDNQLSRRHIDLDPAGYWLVMVEREAGVLKVEHYSNDINDQGLAVDPETGEVIACQGGRKRLPSLTLTGRTAKELCVKIFEELESCPVTMLNHAAYLGRELMRAELALTGGGEYIQD

SEQ ID NO: 18934 - protein, 222 aa, Chlorobium tepidum TLS
MKFFIDTASLDEIKAANELGVLDGVTTNPSLIAKIVKDSTNFTYADFKAHIAKICEIVDGPVSAEVTTLKAGEMIAQGEELAAIHKNIVVKCPLTVDGLKAIKHFSSNGIKTNATLVFSPTQALLAAKAGADFVSPFVGRLDDISTSGMELVRQIVTIYDNYGYLTEVIVASVRNPLHVVESAMVGADIATIPYSVIKQLANHPLTDKGLEKFMEDAAVMKP

SEQ ID NO: 18935 - protein, 414 aa, Campylobacter jejuni subsp. jejuni NCTC 11168 [sequence omitted]

SEQ ID NO: 18936 - protein, 163 aa, Triticum aestivum
  unsure (1)..(163): unsure at all Xaa locations
GKELTALYSSFASKYPIVSIEDAFDQDDWEAWTHLNETSEFQLGGEDLLVTTPKRIAXTAIEKKSCNALLLKVNQIGTLTESIQAAKDSQAAGWGVMVSHRSGETEDTTIADLVVGLRTGQIKTGAPCRSERLAKYNQLLRIEEELGENCIYAGENFRNAHEL

SEQ ID NO: 18937 - protein, 499 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 18938 - protein, 259 aa, Helianthus annuus
MAAASSPREENVYLAKLAEQAERYEEMVEFMEKVVAAADGGEELTIEERNLLSVAYKNVIGARRASWRIISSIEQKEESRGNEGHVSTIRDYRSKIESELSSICDGILKVLDSKLIGSASGGDSKVFYLKMKGDYYRYLAEFKTGDERKLAAENTLSAYKAAQDIANAELAPTHPIRLGLALNFSVFYYEILNSPDRACNLAKQAFDEAIAELDTLGEDSYKDSTLIMQLLRDNLTLWTSDMQDDTAEEVKEAPKPDDQ

SEQ ID NO: 18939 - protein, 110 aa, Oryza sativa
  unsure (1)..(110): unsure at all Xaa locations
MAATIVCVKARQILDSRGNPTAEGYVGCSHRTFARSAVTREASTGVYEAMDXRDGGAEHLGQGVCKATNNANSSIAPNLTGKDPTXQAELDILMDEQLDSTKNERRSEQA

SEQ ID NO: 18940 - protein, 492 aa, Triticum aestivum
  unsure (1)..(492): unsure at all Xaa locations
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHAXKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLALRLKIKPSM

SEQ ID NO: 18941 - protein, 569 aa, Mesorhizobium loti
MVGTTRAVFILDFRTPKIHLWSGSYDAPLVPISGQPLLDRLVNACSENGIEDVALVENLSSGISERFCLQDSTNTLSWRAAHHSDLIERLRDHEGDTLLIWGTPFFDSEVLDGIDTDSGLRGSAWRPDAPTGIYRLSADVLRNFLPESHGAASDVRRQTLSTLAVGLSGLEMALPADELNAGSELLDIRDGVDASIAEFRCDKENLLRRLETSVGGYWRKPIAEHMLLCNTRFPPTAFYDRLATRLEGVLTCYPSQQIDIVSVVGAMTSQQPDFIAVGNGVTDLIQALYSVLNPTIAIPTPTFAGFQTPLDDERKNNFVLAPPYFDLDVRAFLEFATATGADTAIVVNPNNPTGRLVDYADVAWLAEGLGSRGLRLIVDESFIDFPADGRSNSVENLVQSCGNLIVVKSLGKVFGLGGIRLAYLLAGDPALVAAVRRKLPLWNINGIAEYTLFLLPEFAEELEDSLRLLRKDRELLIQELQTVPGLDVVPSQTNFILCRLPENSVSAAELKRRLVLFESVLVRECGYQAMDDADRYLRLTVRSRAENERLAKTLRRTLSHSSTVSETNV

SEQ ID NO: 18942 - protein, 488 aa, Coptis japonica
MEVLSIAIVSFSFLLFLFFILRDSRPKNLPPGPRPSPIVGNLLQLGDKPHAEFAKLAQKYGELFSLKLGSQTVVVASSPAAAAEILKTHDKILSGRYVFQSFRVKEHVENSIVWSECNDNWKLLRKVCRTELFTPKMIESQSEIREAKAREMVKFLRGKEGEVVKIVEVVFGTLVNIFGNLIFSKDVFDLEDPTGGSVELKEHLWKLLDMGNSTNPADYFPIMGKLDLFGQRRAVAEVLQQIYDVWGVMLKERRGTKGSESKNDFVDVLLNAGLDDQKINALLMELFGAGTETSASTIEWAITELTKKPLVVSKIRLELVNVVGDNTVKESDLPHLPYLQAFVKETLRLHPPTPLLLPRRALETCTVMNYTIPKECQIMVNAWAIGRDPKTWDDPLNFKPERFLSSDVDYKGNDFELIPFGGGRRICPGLPLASQFSNLIVATLVQNFEWSLPQGMSTSELSMDEKFGLTLQKDPPLLIVLKARASNI

SEQ ID NO: 18943 - protein, 415 aa, Polysiphonia harveyi
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIASTGEVKGHYMNITAATMEEMYERAEFGKQIGTIIVMIDLVIGYTAIQTMAVWARKNDMILHLHRAGNSTYSRQKIHGMNFRVICKWMRMAGVDHIHAGTVVGKLEGDPLMIKGFYNTLLETHLDINLPQGIFFQQDWASLRKVAPVASGGIHCGQMHQLLDYLGNDVVLQFGGGTIGHPDGIQAGATANRVALESMVIARNEGRDYVAEGPQILRDAAKTCGPLQTALDLWKDITF

SEQ ID NO: 18944 - protein, 509 aa, Oryza sativa
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 18945 - protein, 568 aa, Triticum aestivum
MSQSSPFFSIARAHAGAGGRAAAAALLLRCPAAQLPPTIHCPRYFRLAKVSPAKTLSSHLVLPRATLSSFADADDGSSANSDASGERSGGSELSEMAKAFHISPRMAMSISVVIAFAALTVPLAMRSLLFHGTTKMKVLAYLTLLSGFYMAWNIGANDVANAMGTSVGSGALTLRQAVLTAAVLEFSGAFLMGTHVTSTMQKGILVTSVFQGNDSLLFAGLLSSLAAAGTWLQVASSYGWPVSTTHCIVGAMVGFGLVYGGVNAVFWSSLARVSSSWLISPLMGAAVSFLVYKCIRRFVYSAPNPGQAAAASAPIAVFTGVTAISFAAFPLSRTFSIAVLQALVCGAIGAVFVSRAIKKQLGDLLSSEAEKIATADNTDVQQGGFDVAGPRGAQLQIVYGVFGYMQVLSACFMSFAHGGNDVSNAIGPLAAALSLLQGVASSAEIVIPTEVLAWGGFGIVAGLTMWGYRVIATNWQEKSPELTPTRGFAAEFAAASVVLFASKLGLPISATHTLVGAVMGVGFARGLNRVRAETVREIVVSWVVTIPVGALLSVFYTLILTKILKYFM

SEQ ID NO: 18946 - protein, 198 aa, Leucophanes seychellarum
GGAKKVVISAPSKDAPMFVMGVNEDKYTSEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDAIKAALKEASQGKLKGILGYTEDEVVSSDFITDSRSSIVDAKAGIALSDTFVKLVA

SEQ ID NO: 18947 - protein, 358 aa, Fusobacterium nucleatum subsp. vincentii ATCC 49256
MKDLHGGNIYKFQREGKNSILDYSSNINPLGVPQKFIDIAKENFDKLVNYPDPYYIELRKKIAEFNSLNMDNIIVGNGATEILFLYIRALKPKKVLILAPCFAEYERALKSVSAKIEYFELEESDDFYPNIINLKKEIESNNYDLLLFCNPNNPTGQFIKLEDIKEIIKTCENKNTRIFIDEAFIEFIENWKEKTVSLLKNKNIFIMRAFTKFFAIPGLRLGYGVGFDDEILKKMWEEKEPWTVNSFANLAGLVMLDDKEYIEKSEKWILEEKKFMYKELSEFQYIKAYKTECNFILIKLTNISSESLREKMIEKNILIRDASNFKFLDYHFIRLAIKDRKLNLKMLEILAEFVEYRG

SEQ ID NO: 18948 - protein, 526 aa, Oryza sativa (japonica cultivar-group)
  unsure (1)..(526): unsure at all Xaa locations
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVAXLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLXTEIQEDXERAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTXFLGMLMTLLVPESKGMSLEEVSKENVADDEEATA

SEQ ID NO: 18949 - protein, 254 aa, Triticum aestivum
  unsure (1)..(254): unsure at all Xaa locations
MSRRYDSRTTIFSPEGXRLYHVEYAMEAXPGNAGSALGILAGGPASSSSARRQLTSKLLQSSRSAEKXYKIDSHLACAVAGIMSDANILINTARLHAQRXYALSYQEPIPVEQLVQSLCDTKQGYTQFGGLRPFGVSFLFAGWDKNHGFQLYMSDPSGNYGGWKAAAVGANSQAAQSMLKQDYKDGMTREEAVALALKVLSKTMDSTSLTADKLELAEVFVQPGTGEVQYQVCSPDAMGKLLAKAGLTQPAPEA

SEQ ID NO: 18950 - protein, 419 aa, Corynebacterium efficiens YS-314
MRSVEQQLAMVTQAAVAPEPVRIAIAEALGLMCAEDVQATRALPGFAQAAIDGYAVRAVDVGGERSLSREVPVAPPEKSLPVVGEVAAGSQQPLRLQPRQAVRVQTGAPLPTLADAVLPLAWSDRGRKRVTAQRPVRSGEFVRKEGDDIQPGDVAVSAGAVLGPAQIGLLAAVGRSKVLVYPRPRMSVISVGAELVDIDRQPGLGQVYDVNSYSLAAAGREAGADVYRYGIAAGEPRRIKEIIESQMLRAEIVVIAGAVGGSASEDVREVLRELGEIDTERVAMHPGSVQGFGLLGENRIPVFLLPSNPLASLVIFETFVRPLIRLSLGKSNANRRVVRARALNHVASVAGRKGFIRSRLMRDAETQDYLVEALGGATGAPSHLLAGLSEANAMIRIPEEVTEIRPGDVVDVIFLAQGR

SEQ ID NO: 18951 - protein, 484 aa, Saccharomyces cerevisiae
MSVHAATNPINKHVVLIDNYDSFTWNVYEYLCQEGAKVSVYRNDAITVPEIAALNPDTLLISPGPGHPKTDSGISRDCIRYFTGKIPVFGICMGQQCMFDVFGGEVAYAGEIVHGKTSPISHDNCGIFKNVPQGIAVTRYHSLAGTESSLPSCLKVTASTENGIIMGVRHKKYTVEGVQFHPESILTEEGHLMIRNILNVSGGTWEENKSSPSNSILDRIYARRKIDVNEQSKIPGFTFQDLQSNYDLGLAPPLQDFYTVLSSSHKRAVVLAEVKRASPSKGPICLKAVAAEQALKYAEAGASAISVLTEPHWFHGSLQDLVNVRKILDLKFPPKERPCVLRKEFIFSKYQILEARLAGADTVLLIVKMLSQPLLKELYSYSKDLNMEPLVEVNSKEELQRALEIGAKVVGVNNRDLHSFNVDLNTTSNLVESIPKDVLLIALSGITTRDDAEKYKKEGVHGFLVGEALMKSTDVKKFIHELCE

SEQ ID NO: 18952 - protein, 355 aa, Rhodococcus equi
  unsure (1)..(355): unsure at all Xaa locations
MTTNQGVKVSEDEHSLKAGSRGPTLMEDFHFREKMTHFDHERIPERVVHARGFGAHGYFQVYEPMAEYTRAKFLQDPSVKTPVFVRFSTVAGSRGSADSVRDARGFATKFYTEEGNYDLVGNNIPVFFIQDAIKFPDLVHSFKPEPHNEMPXASTAHDTFWDFVANILKQAHMIMWTMSDRAIPRSFRMMEGFGVHTFRFVNEQGKARFVKFHWKPVLGTHSLVFDEAQKLAGKDPDFHRRDLWEAIEMGNYPEFELGVQMIEEEDEFSFDFDILDATKLWPEEMVPVKIIGKMTLNRNQDNVFAETEQAAFHPGHVVPGIDFSNDPLLQGRLFSYTDTQLIRLGGPNFHEIPIK

SEQ ID NO: 18953 - protein, 90 aa, Oryza sativa (japonica cultivar-group)
RDAKARYVKFHWKPTCGVSCLMDDEATLVGGKNHSHATQDLYDSIAAGNFPEWKLFVQVIDPEEEERFDFDPLDDTKTWPEDEVPLRPVG

SEQ ID NO: 18954 - protein, 186 aa, Zea mays
MAPSAALAPVAFRSAFSTPLASNPTRNRINIEGAFCLPCSARKRASYRSFRVYSLFGGKKDKDENGDEAPSKAGIFGNMQNLYETVKKAQMVVQVEAVRVQKELAATEIDGYCEGELIKVILSGNQQPIRVEITEAAMELGAEKLSELVNDAYKDAHQRSVQAMKERMSDLAQSLGMPAGLGDGLK

SEQ ID NO: 18955 - protein, 474 aa, Bostrychia radicans
RLESGVIPYAKMGYWDPNYVTKETDILALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMDDMLERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLESHLDINLPQGIFFKQDWASLRKVTPVASGGIHCGQMHQLLDYLGNDVVLQFGGGTIGHPDGIQAGATANRVALEAMVIARNEQRDYVTEGPQILRDAAKTCGPLQTALDLWKDITFNYTSTDTADFVETPTANV

SEQ ID NO: 18956 - protein, 333 aa, Magnetospirillum magnetotacticum
MESVAFPIIVALVITALVFDFLNGLHDAANSIATVVSTRVLSPKYAVAWAAFFNTIALVFFTTSVAKTIGTGIVEPGLVDTHVIFGALMGAIAWNVITWGLGIPSSSSHALIGGIAGAGIAKGGLSALVPAGFIKTGSAIVLSPMIGLVLAMSLILVVSWMCRRTAPFTVDRRFRILQFFSAAMYSLGHGGNDAQKTMGIITALLFSQGMLGGEFHVPIWVAVLCQIAMGLGTLFGGWRIVKTMGSRITDMKQIDGFCANAAGAATLFGATWLGIPVSTTHTITGAIIGVGSARKVSGVRWGIAGNIIVAWVITIPAAGSVAALFYGLSTYFW

SEQ ID NO: 18957 - protein, 238 aa, Glycine max
QIIKAKYGQDACNVGDEGGFAPSVQDNREGFVLLVDAIEKAGYTGKIKIGMDVAASEFYTKDGKYDLNFMKQPNDGAHVHSTQSLGQLYKNYVKEFPIVSIKDPFDQDDWGSWASLLASVDIQLVDDLLVTNPKRIAEAIKKKACNGLLLKVNQIGTVTESIQAALDSKAAGWGVVVSHRSGETEDNFIADLSVGLASGQTKTGAPCRSERLAKYNQLLRIEEELGSVQYAGETFRSP

SEQ ID NO: 18958 - protein, 154 aa, Quercus suber
MALSLFGGRRSNVFDPFSLDIWDPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKANMENGVLTVMVPKEEQKKPAVKAIEISG

SEQ ID NO: 18959 - protein, 290 aa, Glycine max
MGSDKILPSHVVANGHAPLDSGHARLKELGYKQELKRDLSVISNFAFSFSIISVLTGVTTLYNTGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNAENGEGINSKPYIFLLGLLLSQYTLTGFDASAHMTEETKDADRNGPKGIICAVVMKF

SEQ ID NO: 18960 - protein, 381 aa, Oryza sativa
  unsure (1)..(381): unsure at all Xaa locations
MGFSGGFVRGSIMSMDQVGNSLTDRIEVSAHNVWIGKGGAYTGEITSPHLSSRAPLSPTAARDEGDWIGLGWIGEREWRRRRPSRPPTSPASPTSAAQASPPPPRRIRSSSASGAPAAAXQRVVAMAGSGKFFVGGNWKCVSIRSSSSXLLQTHGSPVWQDRIFHVLAALYGFVSAIALVQLIRIEXVGCPNTGGQHKRCSISSSAEQLVDIGCQWVILGHSERRHVIGEDDQFIGKKAAYALSQNVKVIACIGELLEEREAGKTFDVCFKQMKAFADSITNWADVVIAYVAVWAIGTGKVVTPEQAQEVHAAVRDWLKTNVSPEVASGIRIIYGGSVNAANCAELAKKEDIDGFLVGGASLKGPDFATIINSVTSKKVAA

SEQ ID NO: 18961 - protein, 137 aa, Shigella flexneri 2a str. 301
MANKPSAEELKKNLSEMQFYVTQNHGTEPPFTGRLLHNKRDGVYHCLICDAPLFHSETKYDSGCGWPSFYEPVSEESIRYIKDLSHGMQRIEIRCGNCDAHLGHVFPDGPQPTGERYCVNSASLRFTDGENGEEING

SEQ ID NO: 18962 - protein, 457 aa, Sphacelaria racemosa
  unsure (1)..(457): unsure at all Xaa locations
DYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSXLNVTAATMEQMYERAEYAESVGTVIVMIDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEERDYVSEGPEILRVAAATCGPLKAALDLWKDITFEYTSTDTPDFVEVATESK

SEQ ID NO: 18963 - protein, 353 aa, Escherichia coli CFT073
MLYTSQTTPEKDQKMSMIKSYAAKEAGGELEVYEYDPGELKPQDVEVQVDYCGICHSDLSMIDNEWGFSQYPLVAGHEVIGRVVALGSAAQNKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLPVPAFTLIAGDRSVSGSATGTPYELRKLMRFAARSKVAPTTELFPMSKTNDAIQHVRDGKARYRVVLKADF

SEQ ID NO: 18964 - protein, 390 aa, Synechocystis sp. WH 8501
MATLLEQLREFTVVVADTGDIQAIETFTPRDATTNPSLITAAAQMPQYQSIVDDTLKTARKELGKDADESAVVTLAFDRLAVAFGLKILEIIPGRVSTEVDARLSYDTEATLEKARYLISEYEKAGVSRDRILIKIASTWEGIKAAEVLEKEGIHCNLTLLFGMHQAVACAEANVTLISPFVGRILDWYKKETGKEYAPTEDPGVMSVTTIYNYYKKFGHKTEVMGASFRNIGEICELAGCDLLTISPKLLDQLNSTEETLPRKLDPEAAAKMDIAKIAMDKAIFDKMHQEDKMAYEKLDEGIKGFTKALETLEEMLKERLTRIEGETRVNNAAADIFRVYDLDGDGFITREEWAGTDVVFDAIDINHDGKITPEEMAAGLGAAICLVEA

SEQ ID NO: 18965 - protein, 225 aa, Zea mays
MDAAGARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEENEDENEESNPSLTPNPANSNPTFSQDQRSNEQQHTPQHGQRVSFQLNAVAAAAAKRPRMTVDQLNIG

SEQ ID NO: 18966 - protein, 391 aa, Tropaeolum majus
MSLKLNPFLFQSQHLPSMTTFRSPKFIMASTLSSGSKSVENLKKPFAPPKEVHVQVTHSLPPQKIEIFKSLEDWALDNILVHLKPVEKCWQPQDFLPDPSSDGFEEQVREIRERAKEIPDDYYVTLVGDMITEEALPTYQTMLNTLDGVRDETGASPTSWAVWTRAWTAEENRHGDLLNKYLYLSGRVDMRQIEKTIQYLIGSGMDPGTENNPYLGFIYTSFQERATFISHGNTARHAKDHGDLKLAQICGIIAADEKRHETAYSKIVEKLFEIDPDGTVMCFADMMKRKISMPAHLMYDGRDDNLFEHFSAVAQRLGVYTAKDYADILEFLVGRWKVGDLTGLSGDGRKAQDFVCGLAPRIKKLEERAQARAKQGPRIPFSWVYDREVQL

SEQ ID NO: 18967 - protein, 925 aa, Medicago sativa
  unsure (1)..(925): unsure at all Xaa locations
MELQVIRIFRLVVACVLCLCIFIRSASSATKGFESISCCADSNYTDPKTTLTYTTDHIWFSDKRSCRPIPEILFSHRSNKNVRIFEIDEGKRCYTLPTIKDQVYLIRGVFPFDSLNSSFYVYIGVTELGELRSSRLEDLEIEGVFRATKDYIDFCLLKEDVNPFISQIELRPLPEEYLHGFATSVLKLISRNNLGDTNDDIRFPDDQNDRIWKRKATSTPSSALPLSSNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLELIQKMREELLLHNRENEALESWSGDPCMIFPWKGITCDDSTGSSIITMLDLSSNNLKGAIPYFVTKMTNLQILNLSHNQFDSLFPSFPPSSLLISLDLSYNDLDGRLPESIISLPHLKSLYFGCNPYMKDEDTTKLNSSLINTDYGRCKGKKPKFGQVFVIGAITRGSLLITLAVGILFFCRYRHKSITLEGFGGKTYPMATNIIFSLPSKDDFFIKSVSVKPFTLEYIEQATEQYKTLIGEGGFGSVYRGTLDDGQEVAVKVRSSTSTQGTXEFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLTHPQPR

SEQ ID NO: 18968 - protein, 340 aa, Glycine max
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 18969 - protein, 753 aa, Escherichia coli O157:H7 EDL933
  unsure (1)..(753): unsure at all Xaa locations
MSQQNEKNPHQHQSPLHDSSEAKPGMDSLAPEDGSHRPAAEPTPPGAQPTASGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILXALKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSADGSFMDELLTLMAAHRVWSRIPKIDKIPA

SEQ ID NO: 18970 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCNHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTFVQGTLGYLDPEYFNRGQLTEKSDVYSFGVVLFEVLCARPAIVQTPSRGMISLAEWVVESQKKGQLEQIIDPNIVAEIRPESLRIFGETAVECLALSGEDRPSMGDVL

SEQ ID NO: 18971 - protein, 439 aa, Oryza sativa; identical to SEQ ID NO: 7220

SEQ ID NO: 18972 - protein, 759 aa, Avena strigosa
MWRLKIAEGGGDPWLRTKNAHVGRQVWEFDPEAGDPEALAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFVGKITPLILELRNELYKTPYSKIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGKSYLSCQDQVYTNLEGKHAHAVNTGWAMLTLIDAGQAERDPTPLHRAAKVLINLQSEDGEFPQQEIMGVFNKNCMISYSQYRDIFPVWALGEYRCRVLAAGK

SEQ ID NO: 18973 - protein, 140 aa, Oryza sativa
  unsure (1)..(140): unsure at all Xaa locations
MVAVINEVHSSFTVQSPNVRYSSEYITSKYGYQKTIVTKNANGQLTAVPTEVGFEFQVDRKVGKTGLMMVGWGXGNNGSTLTASILANKHNLTWETXEXTQTPNYFGVWWFSXHXKGWXVDXKGQDGYXXPFSSILXMVH

SEQ ID NO: 18974 - protein, 659 aa, Hordeum vulgare
MLRVEEALAAVLSAAAACRAAPSAVPLLDALGLVLAEDARAPDPLPPFRASVKDGYAVVAADGPGEYPVIAEARAGDDALGVVVTPGTVAYVTTGGPIPDGADAVVQVEDTEQVAAAPDGSKRVRISARVPEGHDIRSVGCDIEKDSIVLKSGENIGPAEIGLLATVGVTTVKAYRRPTIAVFSTGDELVEPATATLNRGQIRDSNRAMLLAAAIQQKCKVVDLGIAKDTEESLMEHMDAALHSDADIILTSGGVSMGDRDLVKPCLAKMGKIHFEKIRMKPGKPLTFAEITSNDTTKPSKTALAFGLPGNPVSCMVCFNVFVVPAIRLVSGWSNPHLQRVHVRISHPLRADPHRMEFHRAVIRWVLDDGSGRPGYVAESTGHQASSRLLSMKSANALLEVQSSGQILAAGASVQAILISDITSPPLDKLPAASSPLSSHLVSSAKSALAGAAQAAASQNAEVKVAILTVSDTVSSGAGPDRSGPRAVSVVNSSSEKLGGAVVVATAVVPDEVDKIKEILVKWSDIDRVNLILTLGGTGFTPRDVTPEATKCVIEKEAPGLAFVMIQESLKVTPFAMLSRAACGIRGSTLIINMPGNPNAVAECMEALLPALKHAMKQLKGDKREKNPRHVPHAEAAPVDQWERSFRAASSGGGCSCDP

SEQ ID NO: 18975 - protein, 297 aa, Vibrio vulnificus CMCP6
MGYTHASHIDALNQNIAELSDNINVSFEFFPPSTPQMEETLWNSVHRLKTLQPKFVSVTYGANSGERDRTHSIIKEIKAQTGLVAAPHLTCIDASREELINIANDYWANGIKNIVALRGDIPPGGGAPDMYASDLVTLLKSLHDFDISVAAFPEVHPEAKSAQADLLNLKRKVDAGANRAITQFFFDVESYLRFRDRCVAAGIDVEIVPGILPVSNFKQASRFAAQNNVKVPGWMAKQFEGLDDDPVTRQLVGASQAIDMVRILSREGVKDFHFYTLNRAEMTYALCHTLGVRPKKA

SEQ ID NO: 18976 - protein, 429 aa, Thermotoga maritima [sequence omitted]

SEQ ID NO: 18977 - protein, 90 aa, Zea mays
  unsure (1)..(90): unsure at all Xaa locations
SGTGTSESDEEENHALQVGNRKGEIDDTINLYATGTGPQRWDALGLLHXIADFSRMEEDKFLDRLDIEKGTREGINHDERGPILRAMDGC

SEQ ID NO: 18978 - protein, 405 aa, Vibrio parahaemolyticus RIMD 2210633
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPDQVCIFGSDHIYKMDIKQMLNFHTEKKASLTVSALRMPLKEASQFGVIEVDAEGRMIGFEEKPANPKSIPGEPDFALVSMGNYVFEAQVLFSELVEDADNEASSHDFGKDIIPKMFPRGDVFVYDFSTNRISGEKEEVYWRDVGTIDAYWQAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 18979 - protein, 478 aa, Mycobacterium smegmatis
MAEKTSDDIFKLIKDENVEYVDIRFCDLPGVVQHFSIPASAFDESVFEDGLAFDGSSVRGFQSIHESDMMLLPDPNTARIDPFRAAKTLNMNFFVHDPFTREAYSRDPRNVARKAENYLASTGIADTAFFGAEAEFYIFDSVSFDSKINGTFYEVDSESGWWNTGEPFESDGSANRGYKVRPKGGYFPVAPYDHYVDLRDQMATNLQNAGFTLERGHHEVGTAGQAEINYKFNTLLAAADDVLLFKYIIKNTAWQAGKTVTFMPKPLFGDNGSGMHAHQSLWKDGQPLFHDESGYAGLSDIARHYIGGILHHAPSLLAFTNPTVNSYKRLVPGYEAPINLVYSQRNRSACVRIPITGNNPKAKRLEFRCPDSSGNPYLAFAAMLMAGIDGIKKKIEPLQPVDKDLYELPPDEAAAIPQAPTSLSAVIDKLEEDHEYLTEGGVFTEDLIETWISYKRENEIMPIQIRPHPYEFSLYYDV

SEQ ID NO: 18980 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENSCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 18981 - protein, 830 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGLLCSADSIFVFRFFSSNNVCPAPKKFENTQGKFCVIAGWLVYLCRIYMGRGLLVQLHLLFYSCAKNFTWNLMKKSIGKKVDVYMQKYVCLTTFNLEILFFLEENSTNILPFLMQEDMYYAHPLVQDLLSDTLQNFVEPLLTRWPLNKLVREKALQLTMKHIHYEDENSHYITIGCVEKANHFKNPLIKEELYVLCMLACWVENPNGDYFKKHLARIPDYMWVAEDGMKMQSFGCQLWDTGFAIQALLASNLPDETDDALKRGHNYIKASQVRENPSGDFRSMYRHISKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNTCMLHYATYRNTFPLWALAEYRKVVFIVN

SEQ ID NO: 18982 - protein, 177 aa, Silene latifolia subsp. alba
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 18983 - protein, 475 aa, Calonitophyllum medium
ERYESGVIPYAKMGYWDPNYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIKGFYDTLLEPYLEINLPQGIFFQQDWASLRKVTPVASGGIHCGQMHQLLDYLGNDVVLQFGGGTIGHPDGIQAGATANRVALEAMVIARNEGIDYVAQGPQILRDAAKTCGPLQTALDLWKDITFNYTSTDTADFVETPTANV

SEQ ID NO: 18984 - protein, 192 aa, Xanthomonas axonopodis pv. citri str. 306
MLLMLDNYDSFTYNLVQYLQALGAEVTVVRNDAMSVDQIAALRPERIVISPGPCTPNEAGISLQLIEQLGQTTPILGVCLGHQSIGQVYGGDVIRAGNIMHGKTSPIRHQGKGVFAGLPDSYEATRYHSLVVDKTTLPDALEVTAWTENPDGSMEEVMGLRHRQFPVEGVQFHPESILTQHGHALLKNFLQR

SEQ ID NO: 18985 - protein, 863 aa, Oryza sativa
MDLMAVLRSSASFMYYFEIAPIPLSPNCNPMNVLPRFANPIKKWDICHDGDEGGEDVDEGGRLWSPPASSAPTAAVLKAGGATRVGEATALSLDAVLHDTCIISSNHAFLLSTSPDAALPSSSSMTVTTDAGCGAASEEGDVRVGSLSPALDQATMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGETDDDKPEKLEALISAVNSSDSSHIVHVPPGENALSDVLISTPIFTGEEGGSGFAASAAAAAATGAAGFEFDVDPNVDPELALALRLSMEEERARQEAIAKKAAEESSGAENKDHASSSNADSVMAEAEPASNAADDKKDQPKEDDDAQLLQQALAMSMEEGSSGAAAADAAMAEAAVDDQDLALALQMSVQDAGGSSQSDMSKLPGVDPNDPSVKDLLASLHGQGEAPDANAHVTSQTCLDTGVDGGYYTPASHLLEVEGLRILLDCPIDLSALTAFSAVPLGASSSSGDAEDLIRGVPYYRSPTAVAAAKAGHIDAVLVSSATGLLGLPFLTRFPGFANTKQGVDAELTLKPFMPLAIQVLGCSFLSGIKVGKIDPLLGLLKPKLILFPEGQKSLCPATDKQPWSFLYYSKGKTIEVPNMREEFEVRMTTEVAFGLQPRQLDKTTAVARLKAKLLLSNGQYVLAAAKNADYSAPSDRERVISITSPGEALVKNPLLVHTSPLPTRPARVRKRNDAHAINHRPVHPHPNAIIQHGTRLSDAANHTELGASQRMLQLQITIDPTRGLDR

SEQ ID NO: 18986 - protein, 254 aa, Streptococcus pyogenes MGAS315
MAQRIIVITGASGGLAQAIVKQLPKEDSLILLGRNKERLEHCYQHIDNKECLELDITNPVAIEKMVAQIYQRYGRIDVLINNAGYGAFKGFEEFSAQEIADMFQVNTLASIHFACLIGQKMAEQGQGHLINIVSMAGLIASAKSSIYSATKFALIGFSNALRLELADKGVYVTTVNPGPIATKFFDQADPSGHYLESVGKFTLQPNQVAKRLISIIGKNKRELNMPFSLAVTHQFYTLFPKLSDYLARKVFNYK

SEQ ID NO: 18987 - protein, 470 aa, Ceramium diaphanum
GVIPYAKMGYWDPEYAVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQSMGVWSRKNDMILHLHRAGNSTYSRQKIHGMNFRVICKWMRMAGVDHIHAGTVVGKLEGDPLMIKGFYNTLLESHLQVNLPQGIFFEQDWAALRKVTPVASGGIHCGQMHQLLDYLGIDVVLQFGGGTIGHPDGIQAGATANRVALEAMVIARNENRDYVAEGPQILRDAAKTCGPLQTALDLWKDITFNYTSTDTADFVETPTANV

SEQ ID NO: 18988 - protein, 525 aa, Oryza sativa
TRPRAEFGTRVTSTPAMLLYAALFAAALLYLAVAVRRGRGAGLPPGPTGLPLVGSLLSLDPELHTYFAGLAARYGPIFSIRLGSKLGVVVTSPALAREVLRDHDLVFSNRDTPDAACSISYGGGQNIVWNPVGPTWRLLRRICVHEMIGPAGLDSLHGLRRREFMATLRHLRARSGEPVDVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPVRFLPADGGGGRWLDLTGSEQEYMPFLFGRRICAGVAMAERLVVYLLAMLVQAFDWELPAGERLDLAERFGIVMKKATPLVAVPTPRLSNPQLYSA

SEQ ID NO: 18989 - protein, 501 aa, Saccharomyces cerevisiae
MTDVLRSLVRKISFNNSDNLQLKHKTSIQSNTALEKKKRKPDTIKKVSDVQVHHTVPNFNNSSEYINDIENLIISKLIDGGKEGIAVDHIEHANISDSKTDGKVANKHENISSKLSKEKVEKMINFDYRYIKTKERTIHKRVYKHDRKTDVDRKNHGGTIDISYPTTEVVGHGSFGVVVTTVIIETNQKVAIKKVLQDRRYKNRELETMKMLCHPNTVGLQYYFYEKDEEDEVYLNLVLDYMPQSLYQRLRHFVNLKMQMPRVEIKFYAYQLFKALNYLHNVPRICHRDIKPQNLLVDPTTFSFKICDFGSAKCLKPDQPNVSYICSRYYRAPELMFGATNYSNQVDVWSSACVIAELLLGKPLFSGESGIDQLVEIIKIMGIPTKDEISGMNPNYEDHVFPNIKPITLAEIFKAEDPDTLDLLTKTLKYHPCERLVPLQCLLSSYFDETKRCDTDTYVKAQNLRIFDFDVETELGHVPLVERPAIEERLKHFVSAPSSSL

SEQ ID NO: 18990 - protein, 167 aa, Glycine max
  unsure (1)..(167): unsure at all Xaa locations
MDPYKNRPSSAFNSPFWTTNSGAPIWNNNSSLTVGSRYWELNWGMXGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKXPDMGHAL

SEQ ID NO: 18991 - protein, 347 aa, Coccidioides immitis
AEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 18992 - protein, 349 aa, Triticum aestivum
EALVIGLGCLLFSRKGLFTRSSPVYPMDEGYRLILLTTSFQRYSYAAIKKATGNFADEIGRGGSGVVYRGVLEDGRVVAVKALTTSVSRSHGEEEFQAELSVIGRIYHMNLVRIIGCCSQGKHRILVSEFIENGSLATMLFSDEDGDGDGGDDHDVLAWSQRFRIAVGVARGLAYLHSECLEWIIHCDMKPENILLDRDLEPKITDFGLAKLLDRRPEGSASRAGREGNPSGRIRGTRGYMAPEWVSSLAISDKVDVYSFGVVLLELVKGVRVADGDQNTDVRAVAKAVGEKMHSGSVDDLVDGRLAGDFNRAQVKVVVGVALSCLEEERNRRPSMSAVVQALVSVEDA

SEQ ID NO: 18993 - protein, 253 aa, Bacillus subtilis subsp. subtilis str. 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 18994 - protein, 83 aa, Triticum aestivum
  unsure (1)..(83): unsure at all Xaa locations
MAPTGMGVSATFVAPFQGLKSTVGLPVSRRSNGASLGSVSNXGGRIRCMQVWPIEGIKKFETLSYLPPLSTEGFLKQVDYLIR

SEQ ID NO: 18995 - protein, 293 aa, Methanothermobacter thermautotrophicus str. Delta H
MLHGTEVLKKGFAKMTKGGVIMDVVNAEQAAIAEDSGAVAVMALEKVPADIRASGGVARMADPNKVQEIMDAVSIPVMAKVRIGHFVEAQVLEALGVDMIDESEVLTPADERFHIDKKKFTVPFVCGARNLGEALRRIDEGAAMIRTKGEPGTGNIVEAVRHMRIMMSEIREIQNKEEEELWEVSRKIEAPLELVRETAKLGKLPVVNFAAGGVATPADAALMMQLGADGVFVGSGIFKSDNPEGYARAIVEATAHYDDPEVIAEVSRGLGTAMRGLEISEIPEEGRMQDRGW

SEQ ID NO: 18996 - protein, 173 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 18997 - protein, 241 aa, Burkholderia fungorum
MSVARRRVRRADRPRSMRAAHPGCTLPCRESGTRRRLYRNRHRCGTTAMTFAAPRPYALHARMQAAKPRIAVIGTGGTFAMHARDRFDWVEYAESGVTHPIEKLLDDLGELGNVAAAVELVPIPFRALGSTAITPADWLALARLIRDTANRDPDITGFVVTHGTATLEETAWFLDLTLDLPVPVVVTGAQRPSNTGGQRCARQSARRAGRRQRRFEPPRGCARRDGQSRLQCARCDQGRQL

SEQ ID NO: 18998 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 18999 - protein, 315 aa, Gaeumannomyces graminis var. tritici
MTSKDDIRIMGMPPFMIDFLMGGVSAAVSKTAAAPIERIKLLVQNQEEMLKAGRLDRRYDGIMDCFRRTTADEGVMALWRGNTANVIRYFPTQALNFAFRDKFKKMFGYRKEKDGYAKWMAGNLASGGAAGATSLLFVYSLDYARTRLANDNKSAKGGGARQFNGLVDVYRKTLASDGIAGLYRGFGPSVAGIVVYRGLYFGMYDSIKPVVLTGNLETNFLASFALGWCVTTGAGIASYPLDTVRRRMMMTSGEAVKYSSSLDAFRQIVAKEGVKSLFKGAGANILRGVAGAGVLSIYDQLQLIIFGKAFKGGSG

SEQ ID NO: 19000 - protein, 362 aa, Nostoc sp. PCC 7120
MTQNYRITLLPGDGIGPEIMAVAVDVLKVVGQQFDIQFDFQEALIGGAAIDATGEPLPSATLDTCRHSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITNLSQEYPDVELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPQAADKIEQAVLQVLEQGDRTGDIISVGMNLLGCRGMGDSLIKALAKS

SEQ ID NO: 19001 - protein, 168 aa, Saccharum sp.
MALTVMASSATAAAPFQGLKSTASLPVARRSTTSLAKVSNGGRIRCMQVWPAYGNKKFETLSYLPPLTQEQLLKQVDYLLRNNWVPCLEFSKEGFVYRENSTSPCYYDGRYWTMWKLPMFGCTDASQVYKELQEAIASYPELRAILGFDNIRQTQWLTFIAYKPAGSE

SEQ ID NO: 19002 - protein, 269 aa, Zea mays
  unsure (1)..(269): unsure at all Xaa locations
MDAPFFHELRRQASSYLTGKIRSARLALTDVTPTQLMTEEATNGDASPPNVKTMGLIARQAFEVDEYVRITDILHRRFASFDPRQGQGQWQWREAYKALLLLDHLLTHGPRSVAVEFQKDREAIERMATFQHIDERGFPCSLSLTHTRXRLLRLLERPPFLEEERERARKIARVIKGFGSFNLSSAFHAAPQPPPGDEGSRGYGRSNSQFEQRWRHKDGDDSDKENLIQSPEPARVAREVEAEPEEPHHHPFHALGQKQRPEAMLLLSQ

SEQ ID NO: 19003 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 19004 - protein, 776 aa, Burkholderia fungorum
MVRCAGLNYLRLAGQKMDEQLKQSALAYHQNPKPGKISVTPTKPLSNQLDLSLAYSPGVAAACMAIYDEPLDAQKYTSRGNLVGVITNGTAVLGLGNIGPLAAKPVMEGKGCLFKKFAGIDVFDIELSESDPDKLVEAIAMLEPTLGGINLEDIKAPECFYIEKKLRERMKIPVFHDDQHGTAIIASAAILNGLKVVGKKLGEVKLVCSGAGAAAIACLDLLVNLGLSKKNILVTDSKGVIYEGRGNLDPSKERYAANTGARTLADAIRGADVFLGCSSAGVLKPEMVAEMGTQPLILALANPEPEIRPEDAKKVRPDCIIATGRSDYPNQVNNVLCFPFIFRGALDVGATTITEEMKLACVRAIAELAEETDQGDEVAKAYEGHSLEFGPEYLIPKPFDPRLIIKIAPAVAQAAMDSGVATRPIKDMDAYREELGTTVYRTGMVMRPVFAAAKSEPARIVFAEGEDERVLRAAQFVLLEKIARPILVGRPSVIEMRLKKMGSKLKCGDDFEVVDPEDDPRYQQSWQAYHELGAREGVTPDVAKAAMRKFNTLIGAILVRLGEADGMICGMIGQYHTHLKFIEQVLGKAENVQNFAAMNLLMLPGRNLFICDTYVNETPTAEQLADMTMLAAGEIEKFGITPKVALLSNSNFGSAPSSSSQRMAAARKLIVERAPTLEIDGEMHGDAALSEAVRKAAFPGTTLSGEANLLIMPNVEAANITYNLLKMIGGEGVTVGPFLLGAEKPVHILTPAATVRRIINMTAVASANARKPANAK

SEQ ID NO: 19005 - protein, 277 aa, Zea mays
  unsure (1)..(277): unsure at all Xaa locations
TDELSFVWRWNEAFLALGTQFAGGVFLGTALMHFLSDANETFGDLLPDSGYPWAFMLACAGYVGNLNLLFXCQSCTSVSLFGQSERSLQTQHSQNNRLIIHHSNPSLLTFPDIFFPRNGSVQSLPCILFYLLCLALLPNXLIIEPAETKADAWKALWTISLHKIFAAIAMGIALLRMLPNRPLLSCFAYAFAFAISSPVGVGIGIIIDATTQGRVADWIFAVSMGLATGIFVYVSINHLLSKGYRPQRPVAVDTPVGRWLAVVFGVAVIAVVMIWDT

SEQ ID NO: 19006 - protein, 469 aa, Caulobacter crescentus CB15
MSTAKDILNLIKEKDVKYVDVRFTDVRGKMQHVTFDIDLVDDDFLNDGTMFDGSSIAGWKAINESDMKLRPDLSSAIIDPFYQQTTLALFCDVVNPDTGTPYNRDPRSIAKAALNYLKSAGVGDTVYFGPEAEFFIFDDVRWSTAPHDTSYSFDSTELPVNSNKQYAEGNMGHRPGPKGGYFPVNPVDSCQDLRGEMLAVMGELGMKPEKHHHEVAPAQHELGLKFDTMVTMADRMQLYKYVIHNVAAAYGKTATFMAKPMFADNGSGMHVHQSIWQDGKPLFAGDKYAGLSQECLWYIGGIIKHAKAINAFSNSTTNSYKRLVPGYEAPVKLAYSSRNRSASIRIPHVDSPKAKRLEARFPDPMGNPYLTFVALLMAGLDGIINKIDPGAPADKNLYDLPPREQKKIPEVCGSLREALENLDKDRAFLKAGGVMDDDFIDSYIELKMEEVMRLQLHPHPVEFEMYYKC

SEQ ID NO: 19007 - protein, 176 aa, Thermobifida fusca
MSTDVSTLIDRYVRDIPDYPQPGVVFKDITPLLSHPTALRTAIDALAEPLLGSEIDLVAGLEARGFIFAAPVAVRLGAGFVPLRKAGKLPAETLAESYDLEYGTATVEMHADAVPPGSRVLIVDDVLATGGTGRAAVDLIRRAGGTVVGLSVLLELGFLKGREKLADVELRALATV

SEQ ID NO: 19008 - protein, 648 aa, Novosphingobium aromaticivorans
MSDAVTDADGSSAQSHAQSAGHHAVQGHGGHSQGPLLKLAVGAIGVVFGDIGTSPLYALRDTFAGHHKLPLDLLHIYGIISLMFWSMMIIVTFKYVSVIMRADNKGEGGSLALLALINQHTDGKRWGRGIILLGVFATALFYGDSMITPAVSVMGAIEGVAVYRPDMHPLIVPLVVGILIGLFFIQSRGTEKVAAFFGPIMLVYFGTIAVLGALSIAEYPPVIAALSPHHAVTMFIADPWRGFLAMGAAVLAVTGAEALYADMGHFGRSPIRMSWLVFVLPALVLNYLGQASLLIRNPAALESPFYYLAPEWFQWPLLFIASCAAVIASQAVISGAFSVTQQAIQLGFIPRMTIKHTSTAAGQIFIPVINWALMIAVILLVLVFQRSSNLTAAYGIAVTGAMLIDNFLLAVVLFKLWQWKAPAAIAMLAVFFAIDAAYLGANMTKIPDGGWVPLVMGIAIFTLLTTWSRGRALMRENMAEGTIPLDVFTKSAHSSAARVSGTAIFMASTAAGVPSALLHNIKHNKVLHERVVILTVSIEDVPYVDEGERYSVKDFGNGFYRLTLRFGFLEETDVPGALKGVSMCGEPFNMMKTSFFLSRQTLIPSDKPGMALWREKLFAWMLRNAASAMEFFRLPTNRVVELGSQLKI

SEQ ID NO: 19009 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTAVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 19010 - protein, 503 aa, Neisseria meningitidis Z2491
MKWLKRLTVIVGTFYRYRLAGLCASLMGSGWICALLKMMPQSSKLKNEPPAVRLRLALESLGPIFIKFGQVLSTRPDLIPHDYAVELAKLQDKVPPFDARLSREQIEKSLGQSIEKLYAEFETEPIASASIAQVHKARLHSGERVAVKVLRPNLLPLIEQDLSLMRFGAAWVERLFSDGRRLKPLEVVAEFDKYLHDELDLMREAANAGQLGRNFHNSNMLIVPKVFYDYCTSDVLTIEWMDGTPVADIAKLKADGIDLHKLADYGVEIFFTQVFRDGFFHADMHPGNILVAADNRYIALDFGIVGTLTDYDKRYLAINFLAFFNRDYRRVATAHIESGWVPADTRAEELEAAVRAVCEPVFNKPISQISFGLVLMRLFEVSRRFNVEIQPQLVLLQKTLLNIEGLGRQLDPDLDLWKTAKPFLVKWMNGQVGPKALWRNLKNEAPDWAQIIPSLPRKISALIDENRQQEMRDAYIHLVKVQQRQSLWLAVIAVVLLLILLLK

SEQ ID NO: 19011 - protein, 590 aa, Saccharomyces cerevisiae
MGLYVSSENELQEKLKSFRSAKITESRNKLIRYLRIFWFGFNDNIVEPVCTILRFLEISAIFLPLLLLYPISWFGHKLKITDTNITETRGSLIWCQLLRKALELAGPSFIKLGQWAGSRTDIFSHALCHELGKLHSNVTAHSLSFTLEKLSQALKVDKIEDAFDEFNRTPIGVGSIAQVYVGELSQKYIDKYDNIQIGKDGNRWCAIKILHPNVRSQIRRDLKIMKFCADAINWIPTMEWLSLPSEVDQFSILMNIQLDLRIEALNLERFNENFKNSIQVKFPKPFLPLSNRDVMFEEHVYGLSMEKFLSTKKQINDVELCKKVSDPFVDAFLQMLILDDFVHADLHPGNVIIRFVKTNKYGTNIISSELESYRITHDLRKKIEEDQDQDFVGKLKSVLTNYTPQICFIDTGIITELNEKNRINFIALFNALARFDGYRAGELMIERSRTPETAIDKEVFAFKVEKLVDKVKQRTFTLGTVSIGDLLDQMLSMVRSHHVRMESDFVSVVVAILLLEGIGRQLDPNLDLFESSLPILREFGFKREAKSLLKDASTLSMLKIWVGLEVRQLMHLSMKQIYDLVRTDQLCPNY

SEQ ID NO: 19012 - protein, 419 aa, Rhodococcus ruber
AAERERMIWRVGDLLTQRAEEFGQLEALDNGKSAVIAAAVDTAWSADIFRYYAGWATKIEGSTVNVTMPFVPGGEFHAYTLREPVGVCGLIVPWNFPLLMAAFKLAPALAAGNTVILKPAEQTPLTALLLAEIFEEAGFPPGVVNIVPGFGDAGAALAAHDDVDKIAFTGSTEVGKKVVDAAKGNLKKVSLELGGKSPNIVFADADFDAAVQGSLDAWLFNHGQCCVAGTRLFVERPIFERFTEAVAEAASKVKIGPGLDPATQLGPLVSQEQLDRVTGYLREGLIDGARALTGGKRWGDKGFFVEPTVLVDVQPDFSVVREEIFGPVVNAMPFDADDGISAAANDSIYGLAAGIWTRDLSKAHRTARRLKAGSVWINQYNGFDTAMPFGGFKQSGWGRELGAGALDLYTQTKAVNIAL

SEQ ID NO: 19013 - protein, 299 aa, Oryza sativa
  unsure (1)..(299): unsure at all Xaa locations
MAPLRTLVIFLLLLLALVPALSRPDGGGGGFYDPARVTQLSWRPRAFLYSGFLSHDECDHLVNLAKGRMEKSMVADNDSGKSIMSQVRTSSGXFLSKHEDDIVSGIEKRVAAWTFLPEENAESIQILHYELGQKYDAHFDYFHDKNNLKRGGHRVATVLMYLTDVKKGGETVFPNAAGRHLQLKDETWSDCARSGLAVKPKKGDALLFFSLHVNATTDPASLHGSCPVIEGEKWSATKWIHVRSFDNPPDVSLDLPCSDENERCTRWAAVGECYRNPKYMVGTKDSLGFCRKSCGVCDA

SEQ ID NO: 19014 - protein, 232 aa, Salmonella typhimurium LT2
MSFQPSFAGPQPDSRIDRTTFIRRAYLHLAVAIVGFIVLSAAWSFIGVGEYALDVLLAGGRYSWLVVLGAFMLVGMLATRLADNAGNNQTQLIGLGIYVLAESLIFAPLLTVAAYINPSSIGAAAITTLLLVGGLTFTAFSIKKDFSFLRSFLTMAGFIAFGAIIASVICGFSLGVWFSALMVLLCAGFILYDTSNIIHHYPTDRPAGAALHLFASIATMFWYILRIFMSRN

SEQ ID NO: 19015 - protein, 665 aa, Amaranthus sp. 'Iowa'
MVTLNHISSFTKPNKTYLQSSIYAIPFSNSLKPTSSSSILAALFKSHHLLLQSPKPKPPSATITQSPSSLTDDKPSSFVSRFSPEEPRKGCDVLVEALEREGVTDVFAYPGGASMEIHQALTRSNIIRNVLPRHEQGGVFAAQGYARATGRVGVCIATSGPGATNLVSGFADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTFSANEEGLLDQIVRLVGESKRPVLYTGGGCLNSSEELRKFVELTGIPVASTLMGLGAFPCTDDLSLQMLGMHGTVYANYAVDKADLLLAFGVRFDDRVTGKLEAFASRAKIVHIDIDSAEIGKNKQPHVSICGEIKVALQGLNKILESRKGKLKLDFSNWREELNEQKKKFPLSFKSFGDAIPPQYAIQVLDELTLGDAIVSTGVGQHQMWAAQFYKYRNPRQWLTSGGLGAMGFGLPACYGAAVARPDAVVVDIDGDGSFIMNVQELATIRVENLPVKIMLLNNQHLGMVVQLEDRFYKANRAHTYLGNPSNSSEIFPDMLKFAEACDIPAARVTKVSDLRAAIQTMLDTPGPYLLDVIVPHQEHVLPMIPSGAAFKDTITEGDGRRAY

SEQ ID NO: 19016 - protein, 835 aa, Thermobifida fusca
MAAMKAVVMAGGEGTRLRPMTANQPKPLLPVVNRPIMEHVLRLLKRHGFEDTVVTVQFLATLIRNYFGDGEELGMSLRYVAEEVPLGTAGSVKNAEEHLRGEPFIVISGDALTDIDLTDMVRFHRENGALVTIGLKRVANPLEFGIIIVDDNGRIQRFLEKPTWGQVFSDTVNTGIYIMEPEVLDHVAPGENVDWSGDVFPKLLKAGAPLYGYIADGYWEDVGTHESYLRAQADVLSGKVDVEIDGFEVSPGIWVAEGAEVDPEAVLKGPLYIGDYAKVEPGAELREFTVLGSNVVVRSEAFLHRAVVHDNVYVGTRANLRGCVVGKNTDIMAGVRIEEGTVVGEECVLESEAYLANNIKVYPFKTIEAGAVVNTNVIWESKGQRSLFGPRGVSGLINVEITPELAVRLASAYATTLKKGAVVTTARDASRAARTLKRAVISALTAAAINVQDLEATPLPLARFHTSQPGLSGGIALRTTPGDPQSVDIVFLDSSGADLSPAAQRKLERVFSRQEYRRAFPGEIAELSFPSRSVEAYTRELLQSIDLSGVAEANLKVVVDCAGGTGSLILPALLSQIDADVLTVNNRLDEASPTDTPAKRTRDLQRLGELVASARADFGVRFDPVGERIQLVDGSGTLVDDERALLVVLDLVAAERQGGRVALPVTTTRVAEQVANRHGVDVQWTPTSLDALTKAALADDIIFAADGRGGFILPEFSRTCDGIAAFVRLIGLVARTKMSLSQIDQRIPQAHLLRRSVPTPWAVKGSVMREVVEAAQGREIDTTDGVRVIEPDGSWALVLPDTAEAVTHLWAEGPDDETAQRLLEEWSAVVERAEG

SEQ ID NO: 19017 - protein, 470 aa, Nostoc sp. PCC 7120
MFQKILIIGVSTLLLLTSPIMGNAWAQVPGTTPPADTGDTAFMLISAALVLLMTPGLAFFYGGFVRSRNILNTLMMSFVLMAIVGVTWVLWGYSLSFAPGLPFIGGLQWFGLNGVGLETTGYLQGSEPANVVSYAGTIPHQAYMIYQAMFAIITPALISGAIAERMSFRAYCLFVLLWSTFIYTPLAHMVWAKGGFLGLYGGLGALDFAGGTVVHISSGVSALVAAIVLGPRKTHPDRLSPPHNVTFILLGAGLLWFGWFGFNAGSALSVASSTSGSFITNPATTAFVATNTSAAAGALMWLILEGVLRGKPTAVGAATGAVAGLVGITPAAGFVTPLASILIGFITAFVCFYAVSFKHKLNVDDALDTYPVHGVGGTVGAILTAFFATAEVNSGGKNGVLKGNFGELGVELAAIVIAYVIAAVGTWIILKIIDATVGLRVKEEAEYQGLDISEHGEEAYNSEFSDRIVP

SEQ ID NO: 19018 - protein, 153 aa, Zea mays
  unsure (1)..(153): unsure at all Xaa locations
MPMALSSSLRGLVALIPPALPPARPSGAAAAAPAPRARGRTGRGAGVVALAAALPSDAQWLERLPEKKKPLYTHSLPCIEAWLRSLGFTQSREDXAVWVAEKPLWHARLSLDVTDLHIRYLKSGPGNLDKDMERRFSYALSREDIENAILGGP

SEQ ID NO: 19019 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILVLIKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTAIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 19020 - protein, 458 aa, Gelidium crinale
  unsure (1)..(458): unsure at all Xaa locations
PDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPXAYLKTFQGPATGIIVERERMDKFGRPFLGATVKPKLGLAGKNYGRVVYEGLKRGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 19021 - protein, 1005 aa, Novosphingobium aromaticivorans
MAAADRERRGQGTRGRRRQCHGRAAFGLAGRHVRRCRAVRKRRQAHQLCRGGDAGGRQGRIPRAGFGAAGKGDGPARPGADDRVDHRSGRQAAPHGNGGASCARTLDRVRCARRERLGQLRRPAAGRERDGGGDVQGFTRRAAQGAGTAPSGREPAMSALLILLAAGAAQPDADIAARIAAMSDAEKAAQLQSTVTASSPDLPAYDYWNEALHGLARNGVATVFPQAIGLAATWDAPLLERIGTVVSTEARAKYNALPGKDRRRYQGLTIWSPNINIFRDPRWGRGQETYGEDPVLTGTLATAYVRGLQGPDLDHPRVIATPKHLVAHSGPEAGRDSFNVQSSAYDMEATYLPAFRRALTEGKALSVMCSYNSVHGVPVCGADWLLNQRVRKDWGFDGLVVSDCDAIGNINHYQRYRQTNAAASAAAINAGMDLNCGRTYAALPEALAQGLTTREVVDRALARTFAARRKLGDAFGATSPWATIPANTVDTAEHRALALEAARKSLVLLKNNGVLPLRKGARIAVVGPNADSLDTLEANYHGTAAQPVTPLDGFAARYRMSYAQGASLAEGVPVVIPRTAFGAGLKAEFFADPALAGAPLTVRTDARVDFDWNRTSPAAGIPAERYGVRWTGTIAPDGPGEHLLRMDVPRCFDCSGHDAVRLWIDGKQVIADTGDNNAVEARVTFADTRPREIRLELSHASEDEGIRLTWVAPPAAQRERAVAAARDADAVIAFVGLSPAVEGEALQIEVPGFSGGDRTDIALPRAQQDLLETLKATGKPLVVVLLSGSAVAMPWVKENADAVVAAWYPGQSGGTAIADLVDGTLNPSGRLPVTFYARTRDLPAFVDYNMRERTYRYFHGTPLWSFGEGLSYTSFAYGKASAPARIKAGETLTATVSLANVGARNGEEVAQAYLVPPEHLRTIGEFNDPVLRHSLVAYRRAALAKGETTRLSFTLDPRSLSTVDRNGVRAVRPGTYRLFIGGGQPGAASGAEISFTIEGTLELPK

SEQ ID NO: 19022 - protein, 362 aa, Triticum aestivum
  unsure (1)..(362): unsure at all Xaa locations
MVGLTSKYYHLLPKRSSQPNKPMPACSSSERANIDALLSKLCSPDPEEQRSAAAELRLLAKRNAHNRLCIAEAGAIPXLLLSLLSSSDLRTQEHAVTALLNLSIHEDNKASIMSSGAVPSVVHVLNNGSMEARENAAATLFSLSVVDEYKVMIGGTGAIPALVVLLSEGSQRGKKDAAAALFNLCIYQGNKGRAIRAGLVPLIMGLVTNPTGALMDEAMAILSILSSHQEGKAAIGAAEPVPALVELLGSGSPRNRENAAAVMLHLCSGEQQLVHLARAHECGIMVPLRELALNGTERGKRKAVQLLERMSRFMVQQQEEQESHSRLQAAAAQVLPQAPEQVQESEIPDQLESPASQYPTLL

SEQ ID NO: 19023 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 19024 - protein, 67 aa, Zea mays
  unsure (1)..(67): unsure at all Xaa locations
INALCMAFYARSEEARQSHATQNFALRALALEDALSKGLPIETEIASLQSYLASXDKNSVLDLVLAS

SEQ ID NO: 19025 - protein, 478 aa, Xanthomonas campestris pv. campestris str. ATCC 33913
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 19026 - protein, 118 aa, Oryza sativa
  unsure (1)..(118): unsure at all Xaa locations
RLLGWKIVNFFSHHPXSLHVGSFLFDDVXIPLNYKHIEGFCVNTYTLIRXDGKPYLVKFHXKPTCAVKCLLDDEAVTVCDTCHNHATNDLTHSIAAWNYPXWKLYIQTIDPYHEDKFD

SEQ ID NO: 19027 - protein, 300 aa, Bacillus anthracis str. A2012
MGEKMLGIINATGSFPSLKKVTGHRSLAALPFGGRYRLIDFMLSNMVNSNIHSVAVFTSHKNRSLMDHVGSGKQWDLDRKRDGLFLFPPNCQCDQDEFGSFAHFRRHIDYFLRSREEYVVITNSHLVTALNFQAVLERHIHTAADITEVCHEGVSLQTYVLKKQLLLDLFEAYKDMEQYSLFDVVREKRGKSLHIATYEHTEYVAIIDSIESYYKHSLEILQPAIWKQVFKKEAPIFTKVKDEPPTRYVKGAAVKNTMIANGSIIEGEVENSVVSRSVKIGKGSIVRLALNAMRKLEITV

SEQ ID NO: 19028 - protein, 199 aa, Neisseria meningitidis Z2491
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 19029 - protein, 372 aa, Perilla frutescens
MAQAVGVSLTTQAKESTLHPKFIRDEDERPKVAYDQFSSEIPVISLARIDESGDKRAEVCRRIVAACEDWGIFQVVDHGVHPMVVEGMTRLAREFFALPDHEKLRFDMSGGKKGGFIVSSHLQGEVVQDWREIVTYFSYPITARDYSRWPDKPVEWRAVTEGYSQLVMELGCKLLEILSEAMGLERDGLSKACVEMDQKIVVNFYPKCPQPDLTLGLKRHTDPGLITLLLQDQVGGLQATRDAGNTWITVQPIQGAFVVNLGDFAHYLSNGRFKNADHQAVVNSKCSRLSIATFQNPAPDAKVYPLKLREGEKAVMEEAITFSEMYKRKMSNDLELARLKKLANEKKLQEDSKNPKFENKVEPCKVLEEILA

SEQ ID NO: 19030 - protein, 108 aa, Triticum aestivum
  unsure (1)..(108): unsure at all Xaa locations
MAPTVMASSATSVAPFQGLKSTAGLPVSRRSNGASLGSVSNGGRIRCMQVWPIEGIKKFETLSYLPPLXSTEALLKQVDYLIRSKWVPCLEFNKVGFIFREXNASPGY

SEQ ID NO: 19031 - protein, 410 aa, Brucella melitensis 16M
MSDDVVLSLHVPEPEWRPGDAPDFSHVKIPRAGSVRRPEIDEKPEAMRDMAFSIIRVLNREGEAVGPWAGTLTDEELKDGLRHMMMLRAYDARMMMAQRQGKTSFYMQHLGEEAVSCAFRKALRKGDMNFPTYRQAGLLIADDYPLVTMMNQIFSNEQDPLKGRQLPVMYSSKEHGFFTISGNLATQYTQAVGWAMASAISHDTKIAAAWIGDGSTAESDFHAALVFASTYKAPVVMNIVNNQWAISTFQGIARGGSGTFAARGHGFGIPSLRVDGNDYLAVHAVAKWAVERARRNLGPTIVEYVTYRAGGHSTSDDPSAYRPKAENDAWPLGDPILRLKNHLIKRGVWSEERHKQAEAEVMDIVVSAQREAEAIGTLHDGRKPSMRDMFEDVYAETPPHLIRQRQEAGF

SEQ ID NO: 19032 - protein, 373 aa, Triticum aestivum
MALTGDYKLISTDDMLQGHAELCIHAYGFVKSMALKCAIELGIPGAIHGHGGGATLGELATIIALPPSRLPRLRRLMRVLTVSGVFSVQNQQPDDPAGCAAVVYGLTAASRLLVGDGESIVGAAPPRSLMVDPNLTAPFSGMSAWFMDDEQPRSFFEMHHGEDMWEMAARDAALSRTIGDGMTDDSRFVVEVLLREGRARDVFSGVRSMVDVGGGTGTIAKAIAAAFPHVECSVLDLPHVVAEAPAGGEVRFIEGDMFEHIPPADAVLLKSVMHDWRDDECVKILRRCKEAIPSREAGGKVIIINMVVGSEKSKGNSTKKGGGTSIVRSSSSWFLREVNEKSMSGRRSFLEAGFSGYSIIPMLGIRSIIEVYP

SEQ ID NO: 19033 - protein, 134 aa, Triticum aestivum
  unsure (1)..(134): unsure at all Xaa locations
RKLEVSLKEMLIDFLPTDGGXSLAEAPALVKAPGGAPANVPIGAPRLGGMAVLRLKLGDDXFGQMLDKMLRHNGVNTVGDNFDSGARTALDFVTLTALGXRKLMFYRNRKAIMLLTANELMVDIINKAEVFHYR

SEQ ID NO: 19034 - protein, 486 aa, Streptococcus pyogenes SSI-1
MKFTIITNYDTLSRKSFTIEGDNMTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 19035 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRAKVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 19036 - protein, 358 aa, Cryptococcus neoformans var. grubii
MGGCMSSPATGDPVAEARSKEIDRALKEDEKRMAKEVKLLLLGAGASGKSTILKQMRLIHDRPFESDEVEDYRKLTFSNIVGGMRAIIDVMDELGLAVQPENRRYISLVDAEPPINTNDSYPIKYLTALKRLWEDPSVQECYKRGNEFALAENMPYFYADLDRLFAKGFKPSSDDILRVRSKTTGITETRFPIRDVVFRLFDVGGQRSERRKWASCFENVTAILFLVALSDYNSCLIEDRESNGMQEALMLFDSICNSQWFTKSSIILFLNKADLLQVKIQDPSQQLHENFPEFEGKPYSFQDAVDFFKIKFRSLNRMPQKEIYCHVTTAVDRQNVKVVMTACQDTILKNALRDMAIL

SEQ ID NO: 19037 - protein, 432 aa, Prochlorococcus marinus str. MIT 9313
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 19038 - protein, 165 aa, Synechocystis sp. WH 8501
MFFIQSPIATLGCLILWFGWFGFNAGSTLELNSPAVAHILVNTLVAGATGGIIGTLSAWFMFDNKPSLTFIINGILAGCVSITASCAYVHLLSAVFIGMVGGWFVVWATDFIDRFGIDDPVGAIPVHLFCGFWGTLAVGFFSAGPGVVDWVISEKAFPIGGNRLD

SEQ ID NO: 19039 - protein, 221 aa, Glycine max
  unsure (1)..(221): unsure at all Xaa locations
MGVTPKIAPSMLSSDFANLASEAQRMLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQXTLIQ

SEQ ID NO: 19040 - protein, 427 aa, Batrachospermum louisianae
  unsure (1)..(427): unsure at all Xaa locations
IEAAAAVAGESSTATWTVVWTDLLTACDLYRAKAYKVDSVPNTSDQYFAYISYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAGTGEVKGHYLNVTAATMEDMYERAEFAKELGSXICMIDLVIGYTAIQTMAVWARKADMILHLHRAGNSTYSRQKIHGMNFRVICKWMRMAGVDHIHAGTVVGKLEGDPLMIKGFYNTLLLSHLDVNLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKDISFNYTSTDTADFV

SEQ ID NO: 19041 - protein, 125 aa, Glycine max
  unsure (1)..(125): unsure at all Xaa locations
MATATLSPADADKLSNLKSSVAALSQISENEKNGFTSLVARYLSGEAQHVEWXVLKLNGGLGTTMGCTGPKSVIEVRDGLTFLDLIGRQIENLNSKYGSNVPLLLMNSFNTHDDTQKIVEKYKNS

SEQ ID NO: 19042 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 19043 - protein, 418 aa, Zea mays
  unsure (1)..(418): unsure at all Xaa locations
MAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTVSEASKPSDDFPEFKLSDAPAPPAENLNGKHEPKSPKAAPRSPKAATHPTFATSVKKPIGAKKVGGKTGGLGVRKLTTKPNESLYEQKPEEPKPAIPALTAPTAKGGPSLHSRFEYVDNEQSSVSRTGGSGSRVTGHVAPPKSSDFFQEYGMGNGFQKKSSNASKAQIEETDEARKKFSNAKAXISSSQFFGTQNREEKEAQLSLQKFAGSSSISSSDLFGRTNVDDSNLDLSAADLINRISFQASQDLSSLKDIAGETGKKLTSFASNFISDLDRIL

SEQ ID NO: 19044 - protein, 488 aa, Leptonematella fasciculata
  unsure (1)..(488): unsure at all Xaa locations
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKXXXXXXXXGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 19045 - protein, 182 aa, Streptomyces galbus
MTELANIPELLASRIRDVADYPEPGVMFKDITPLLADPVAFTALTDTLAAGRRRHPRTKVVGLEARGFILGAPVAVRAGLGFIPVRKAGKLPGATLSQAYDLEYGSAEIEVHAEDLAAGDRVLIVDDVLATGGTAEAAIQLIRRAGAEVCGLAVLMELGFLGGRARLEPILDGAPLEALLQV

SEQ ID NO: 19046 - protein, 379 aa, Leptospira interrogans serovar lai str. 56601
MNLNGAELMIRFLEFAGVEIVSGIPGGASLPIYDALYESKIRHILARHEQGAGFIAGGMARANGKPGVCFASSGPGVTNLITAVADAKMDSIPLIVITGQVPVSMIGTDAFQEIDTFSLSVPITKRSYLVKKIEDLIQILPQAWKTAIEGRPGPVWIDVPKDVASAKIDWDISREKEIWNIQKIEFKDTIDLEWKKTFKELLSKAKKPVFYIGGGLNRPLAAELFCILLEKLNFPTVSTLMGLGICPYEHPRFLGMLGMHGSRAANLVLEEADLLVALGVRFDDRATGKLNEFCPNAKIVHVDIDATEIGKLKNPNLFLKHGVENFITQILEEDLSSEHLSSEEWLNQVQTLKTLYGFSIPKRIKFYIRFRFYKVSRTF

SEQ ID NO: 19047 - protein, 402 aa, Physcomitrella patens subsp. patens
MATCVAAAVSSSLTALTSERATTGITASVQSSAFVGIKVSVCKDASALLKAVNAGTSRQPLVEPVRAQSVAAPASTNASTSSKKTDTKSTVIITGASSGLGLATAKVLADSGEWHVIMACRDFLKAERAAKSVGMPKENYTVMHCDLSSLNSVKQFVDNFRRSGRPLDVLVCNAAVYLPTAKEPRYTADGFELSVGTNHLGHFLLANLLMEDIQHKENNNSRRVIIVGSITGNTNTVAGNVPPKANLGDLRGLAGGLDGVRSSVMIDGGEFDGAKAYKDSKVCNMLTMQEMHRRFHEKTGVTFASLYPGCIATTGLFREHYSLFRTLFPPFQKYITKGYVSEEESGRRLAQVVSDPSMNKSGVYWSWNNQSGSFENELSQEASDAEKAKKLWEVSEKLVGLA

SEQ ID NO: 19048 - protein, 299 aa, Zea mays
MASRRVSLLLGVLLSYSAAVAVAVAAANFNQEFDITWGDGRGKIQDNGQLLTLTLDRTSGSGFQSRHEYLFGKIDMQLKLVPGNSAGTVTAYYLSSQGNTHDEIDFEFLGNVSGEPYTLHTNVFTQGQGQREQQFRLWFDPTKDFHTYSILWNPKHVIFMVDEMPIRDFRNLESKGVAFPKNQPMRLYSSLWNADDWATQGGRVKTDWSHAPFSASYRGFKADACVAVAGGRTRCGATVGTEGTGAPASAAGAGDWYNQELDLTLQQRMRWVQRKYMIYNYCTDPKRYQQGLPAECSMQ

SEQ ID NO: 19049 - protein, 119 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAM

SEQ ID NO: 19050 - protein, 298 aa, Oryza sativa
MSFGAVDVDDGGAAATAAASGGEEVRAMPAEVSWEMLDKSRFFLLGAALFSGVSAALYPAVVLKTHLQVSPPPAAAASTTAAAILRRHGPRGFYRGFGASLAGTVPARAVYMAALEATKSAVVWTPVDVVSQRLMVQTAAAGPPYRGGADALRRILRADGVRGLYRGFGVSVLTYAPSSAAWWASYATAQRLIWRALGPAHHDSRASVVAVQGASAAAAGGAAALVTMPLDTVKTRLQVMDGGGASLASEARALVREGGWGACYRGLGPRWASMSLSAATMVTAYEFLKRLSTKDTSL

SEQ ID NO: 19051 - protein, 215 aa, Oryza sativa
MTDPAAAAGRRKRRRARTVKNREEVESQRMTHIAVERNRRKQMNEYLAVLRSLMPASYVQRGDQASIIGGAINYVKEMEQLLQSLEAHRHARRARTDAAAALPFAGFFTFPQYSNADVSGSKPSSVADIEVTMVESHANLKVLSRRRPRQLLRMVAGLQHHRLAVLHLNVASAGHMALYSLSLKVKEDCQLTSVDDIAAAVHGIVETIEQEQQQQ

SEQ ID NO: 19052 - protein, 97 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEI

SEQ ID NO: 19053 - protein, 231 aa, Triticum aestivum
  unsure (1)..(231): unsure at all Xaa locations
MGTHPVARGDTLRKGTRRSREVTLHQCKGYPPAPGAYPPASPGAYPPCSLGHTLLRPERVAVTGRRGSSPTSCSGVAGAHGGGHGYPSGGHGYPPQQHGYPQQGYPPQXGYPPQQHGYPPQQHGYPPAGYPGSSGHSGSHGGGGMGMGGMLAGGAAAAAAAYGAHKISHGGHGGGGHMMGGMMGGHGGYGGGYGHHGGKFKHGKHGHGKFKHGKHGKHGMFGGGGKFKKWK

SEQ ID NO: 19054 - protein, 432 aa, Leptospira interrogans serovar lai str. 56601 [sequence omitted]

SEQ ID NO: 19055 - protein, 367 aa, Ipomoea nil
MNQEIDNIIPMDFNKADQLPDSHTWLDDHSPVNSSSTHESVPLIDLYDPQAVDKIKMACETWGIFQVTNHGVPWSLLAQIEHQARRFFELAPEQKLRAVRSPGSLAGYGTVRISKFFDSQMWSEGFTVAGSPLEHARQVWPQDYSDFCSVIDDYQEKMRGLAEKIAALMFKSLGLSPGEDVEWFEPNGLSNSTQAYLQMNWYPKCPDPTRAMGLAQHTDTSLVTLLYQTSNIRGLQVYGPNLNWVDVKPISDAIVVNLGDLMQIISNGRFKSVLHRAIVSEAHNRISVGYFFGSSKNVEISPSLKLIKGSEFPMYKPISWNEYLDIKNKYFNKSLEMIGFNSDVEKSNALASGDEAPLGSEVEAIKV

SEQ ID NO: 19056 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 19057 - protein, 388 aa, GIBBERELLA ZEAE PH-1
MAAPQIPSQQWAQIFEKTAGRIWAQSHLFQSYPAIHSSCNTPVTFQALYSHLFLTAIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLEAISPILCAGITVYKGIKESGVKAGQSLAIVGAGGGLGSIAVQYAKAMGIHAIAIDGGEEKEKMCMSLGAQTFIDFTKTKNIVADVKATTNDGLGPHAALLVAAAEKPFQQATQYIRSKGTVVCIGLPAGAQFSAPVFDTVVRMIQIKGSYVGNRADTAEAIDFFRRGLIKVPFKTVGLSELNEVFKLMKAGQVAGRYVVDTSR

SEQ ID NO: 19058 - protein, 294 aa, Francisella tularensis subsp. tularensis
MKGIILAGGSGTRLYPLTLGVSKQLLPVYDKPLLYYPLSVLMLAGIREILIISTVRDISLIQELLGDGSQFGIQLSYKIQPSPDGLAQAFILGEEFLAGDSACLILGDNIYYGQGMTTMLESARAQCGGPAGGACVFGYYVNDPHRYGIVEFDKQKNVISVEEKPQNPKSHYAITGLYFYDNNVVEYAKQVKPSARGELEITSLNELYLKENKLNVELLGRGFAWLDAGTHDSLLEAGQYVATIEKRQGLKIACLEEIAWRKGFISTQQVLAQAEKLSKTEYGQYLKNLIKDGL

SEQ ID NO: 19059 - protein, 568 aa, Zea mays
MEEARDHRLSSTAGRPFLSGFCAAALRRKPLGARASAAAAATGEGLVRQLGVLDLVLLGIGASIGAGIFVVTGTVARDAGPGVTISFVLAGAACVLNALCYAELASRFPAVVGGAYLYTYAAFNEITAFLVFTQLMVDYHIGAASIARSLASYFIEFLELIPLLKGQIPSWVGHGEEFFGGVVSINILAPVLLIILTAILCYGVKESSAVNTFMTTLKIIIVIVIVFAGVFEVDVSNWSPFMPNGFKSVVTGATVVFFAYVGFDAVANSAEEAKRPQRDLPIGILGSLIACVLLYVAVCLVITGMVPYTLLGEDAPLAEAFAAKGLKFITVLISIGAVAGLTTTLLVGLYVQSRLYFGLGRDGLLPSVFAEVHPTRHTPVQSQIWVGCVAAVMAGLFNVRMLSHILSVGTLTGYSVVSACVITLRWNDKGTSRRSLGSMSIWQEGVLSLVIVALCGFIVGLCYRFNYAIAFMVVAFLIAVAASFALQFRQVYVDPPGFSCPGVPLVPIISVFFNMVLFAQLHEEAWYRFVILSLIAVGVYAGYGQYNAVPSSSEHSTIGYHGIPSEAA

SEQ ID NO: 19060 - protein, 139 aa, Schizosaccharomyces pombe
MAKVPRNFKLLEELEKGEKGLGESSCSYGLTNADDITLSDWNATILGPAHSVHENRIYSLKIHCDANYPDAPPIVTFVSRINLPGVDGETGKVNPHKIDCLRHWKREYSMETVLLDLKKEMASSSNRKLPQPPEGSTFF

SEQ ID NO: 19061 - protein, 466 aa, Glycine max
MASRAIVQQQQARGEAVVGGGKQQKKNGVADGRNRKALGDIGNLANIRSAVEVKPNRPITRSFGAQLLANAQAAAAAGNNKKQACANVAGPPAVANGGVAVAKRVAPKPGSKKVTVTVKPKPSEEVTDIDASPDKKEVLKDKKKEGDANPKKKSQHTLTSVLTARSKAACGITNKPKEQIIDIDASDVDNELAAVIDDNELAAVEYIDDIYKFYKLVENESRPHDYIDSQPEINERMRAILVDWLIDVHTKFELSLETLYLTINIIDRFLAVKTVPRRELQLVGISAMLMASKYEEIWPPEVNDFVCLSDRAYTHEQILTMEKTILNKLEWTLTVPTPFVFLVRFIKASVPDQELENMAHFLSELGMMNYATLMYCPSMVAASAVFAARCTLNKAPFWNETLKLHTGYSQEQLMDCARLLVGFYSTLVNGKLRVVYRKYSDPQKGAVAVLPPAKFLLPEGSASQHS

SEQ ID NO: 19062 - protein, 463 aa, Streptomyces avermitilis MA-4680
MRPHVSHPHELVVLDPATEEVVATVPAATPQDVDAAVVRASKAQVRWAALAPGERARLLRRFAVVVDEHLEELARLEVREAGHVIGNARWEAGNVRDLLDYAAGGVERLTGRQIPVPGGLDITILEPLGVVGVIAPWNFPMPIAAWGTAPALAAGNAVILKPAETTPLTALRLAELALEAGLPEHLFQVLPGAGPVAGNALVEHPGVAKIVFTGSTAVGKQVWAKGSALLKRVTLELGGKSPNIVFADADVEAAAAAAPMAFLDNSGQDCCARTRILVQRSVYDRFLALLAPAVESVAVGDPLDERTAMGPLISKVQLERVRSYVPAGAPALRGKAPEGPGFWFPPTVLTDVDPHAPVAVEEVFGPVAVVLPFEDEADAVRLANATEYGLAGSIWTRDVGRALRVSGAVRAGNLSVNSHSSVRYWTPFGGFKQSGIGRELGPDALTAFTETKNVFISTEGPAQ

SEQ ID NO: 19063 - protein, 360 aa, Arabidopsis thaliana
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 19064 - protein, 735 aa, Oryza sativa
MSGQERDDVPMLELQRFPTRSVSMCIPVRDDIYEDSIISHSGPIFTPAPTQYTSVAIPSGNRDMLDKLPRPKVKSKPHVVTPEEVGISNWPYDQHVPKNKHLMMYSEPLGLCDNPDCVDCPRACKNKRHFQRSLAPFDNKFHNILYGYGDRWKKKAGHYLSYIPIMKPHDKAVHRWNQFFVISCLLAIFNDPLFFFLLSVDKDYKCIVFNWNFAIALAVGRSVTDAIYFLHMLLQFRLAYVAPESRVVGTGDLVDEPMKIAMRYLRGFFVLDLFVVLPLPQVMILLVIPKYVGLSSANYAKNLLRATVLLQYVPRIIRFVPLLGGQSTNGFIFESAWSTFVINLLMFVLAGHVVGSCWYLFGLQRVNQCLRDSCAASNISKALCNNCTDCGITGINRTNWLNNSDLTGCFDTKSGNFPYGIYQQAVLLTTEPGLKRYIYSLFWGFQQISTLAGNLIPSYFVWEVIFTMAIIGLGLLLFALLIGSMQNFLQALGKRRLEMQLRRRDVEQWMSHRRLPEDLRRRVRSAERFSWVATRGVNEEELLSNLPEDIQRGIRRHFFGFLKKVRLFNLMDNATWDAICDKLRQNLYITGSDILYQGGPVEKMVFIVRGRLESISADGNKSPLQEGDVCGEELLSWYLEQSSVNRDGGKIKLHGMRLVAIRTVRCLTNVEAFVLRARDLEEVTSQFSRFLRNPLVLGTIRYESPYWKNLAANRIQVAWRYRKRRLKRAEMQRLQ

SEQ ID NO: 19065 - protein, 473 aa, Chauviniella coriifolia
YESGVIPYAKMGYWDPDYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATIEHMYERAEFAKQLGTIIIMIDLVIGYSAIQTMAIWARQNDMILHLHRAGNSTYSRQKIHGMNFRVICKWMRMAGVDHIHAGTVVGKLEGDPLMIRGFYNTLLLPYLDINLPQGIFFQQDWAALRKVTPVASGGIHCGQMHQLLDYLGNDVVLQFGGGTIGHPDGIQAGATANRVALESMVIARNEGRDYVAEGPQILRDAAKTCGPLQTALDLWKDITFNYTSTDTADFLETPTANV

SEQ ID NO: 19066 - protein, 409 aa, Zea mays
MGQGTPGGMGKQGGAGDRKPGDGGDKKDKKFEPPAAPSRVGRKQRKQKGAEAAARLPNVAPLSKCRLRLLKLERVKDYLLMEEEFVAAQERLRPQEDKAEEDRSKVDDLRGTPMSVGSLEEIIDESHAIVSSSVGPEYYVSILSFVDKDQLEPGCSILMHNKIQEIKEAVKLPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 19067 - protein, 344 aa, Zea mays
  unsure (1)..(344): unsure at all Xaa locations
MVLESTMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIVFIGSPVTYDKKVLETIGKKLKKNNVALDVVDFGETDDEKPEKLEALIAAVNSSDSSHIVHVPPGDHALSDVLISTPIFTGEEGGSGFAASAAAAAATGATGYDFGVDPNVDPELALALRLSMEEERARQEAIAKKAAEDNKDQPSSSTDAIMAEAELTLNAPADVDADLLKDDDDAQLLQQALAMXMDEGASGAAAVADAAMAEAAADDQDLALALQMSGQDAEAAGQSDMS

SEQ ID NO: 19068 - protein, 134 aa, Zea mays
MPGRHHHHQQQQQLAAVAPKGCVTVRVGLEGEEQRRFAVPLGHLKHPLFGALLEEAEREYGFRHQGALAIPCRVDRFVQVEHLIGQDLRGTSCAQHLVDLDGALASGGGGGGGAHHHHQHHHLHLPRFVGCFRA

SEQ ID NO: 19069 - protein, 180 aa, Solanum tuberosum
MASSIVSSAAVATRANGAQASMVGPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 19070 - protein, 473 aa, Synechococcus sp. PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDCLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRPHPYEFALYYDC

SEQ ID NO: 19071 - protein, 143 aa, Zea mays
  unsure (1)..(143): unsure at all Xaa locations
PFTAGWLLIVRKPFWLIFTNWSSIIFVSGWGGPGGYVYQKAYLEFFCAKEKLDQLIEKIKAFPSLTYIAVNKDGETFSNISPNAVNAVTGGVSPGKEIIQPTVVDHASFMXXXXXXXEXXXXFFFPPPPSQTRVPPPTQYPPT

SEQ ID NO: 19072 - protein, 339 aa, Pseudomonas syringae pv. syringae B728a
MSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITKDDVFLTPKSPSVLPGITRLSLIELAKSRLGLTVEEGDVFIDQLGEFKEAGACGTAAVITPIGGISYKDNLHVFYSQTEVGPVTQRLYKELTGVQSGDIEAPAGWIVKV

SEQ ID NO: 19073 - protein, 447 aa, Oryza sativa
  unsure (1)..(447): unsure at all Xaa locations
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSXGETEDTFIAELAVGLATGQIKTGAPCRSERLAKYNQLLRIEEELGAAAVYAGAKFRAPVEPY

SEQ ID NO: 19074 - protein, 92 aa, Triticum aestivum
MAGQARAFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 19075 - protein, 174 aa, Zea mays
  unsure (1)..(174): unsure at all Xaa locations
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKXTAKSSDGSIKKDALGHVGASSSAAQGGAYNQGMGYMQPQYHNGDISN

SEQ ID NO: 19076 - protein, 89 aa, Glycine max
  unsure (1)..(89): unsure at all Xaa locations
ASSXISSPTVTTVXNRADAGXVATIXGXXSMAXFPTRKTNXDITSXASNGGRLQCMXXWPPVXGKXXFETXSYLPDLXDXQLAKEVEYL

SEQ ID NO: 19077 - protein, 521 aa, Agrobacterium tumefaciens str. C58
MSSGIPRNRVGITVVSGGRRRARAGSRAPLQNQKGKSMTTFSASNWIDGTFVSSSKRGRSIDPATYETIGDYPDDGGAAAQSAIEAAKRAFRGTAWRDDAELRARVLDQMASAIERNRERLIDILSLENGKLLGEAALEIDGSPSKLRYWAAMARTEAGRAKSPKPGSLSVILRQPMGVAGIIVPWNSPVILSVRSFAPALAAGCTVVVKMPGQTAQVGSVITEVLAEATDLPEGVVNMFVESGADGAALLVESPDVPTISFTGSTQTGRTIGAIGAKRMKRFGLELGGKTPMIVFDDADLEAMLPVLEKALTIFAGQFCMTGSRLLVHSSIYELVRDRLAERLRAVKVGPASDPASDMGPLIDKENVARVDSVVKDALSKGATVVVRGGPVPEGPLAKGAFFRPSMLEVFDNSLPIVQQETFGPVITIQRFSDEREAVVLANDNDYGLSASVWTRDLDRSLRVAQALEAGSVFVNDWAKVYDGTEEGGFKQSGLGRLNGVAAIEDFIEYKQVALKPGLLR

SEQ ID NO: 19078 - protein, 297 aa, Xanthomonas campestris pv. campestris str. ATCC 33913
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVMCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHEKHGAPAKEIIRSALAAADARG

SEQ ID NO: 19079 - protein, 284 aa, Zea mays
  unsure (1)..(284): unsure at all Xaa locations
EDSKTSSLWVRREVAVFGCRELSEEISRGXXGWCXXYVVESKLVFSTXTRRRGCSFHLKGGAEKVVICAASKDAPMFVVGVNEKEYKSDINIVSNASCTTNCLAPLAKVINDKFGIVEGLMTTVHAITATQKTVDGPSSKDWRGGRAASFNIIPSSTGAAKXAVGKVLPVLNGKLTXGMSFRVPTVDVSVVDLTVRLEKSATYDEIKAAXVKAEAEGSLKGILGYVEEDLVSTDFQGDSRSSIFDAKAGIALNGNFVKLVSWYDNEWGSRTRVVNLIRHMTSTN

SEQ ID NO: 19080 - protein, 462 aa, Oryza sativa
MATDSSSSAAADKNTVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLAKDVAKNSTEDGNNSWPSSPVAASQPTNQADAIPDLKLAEASKEVANEKTEPEVIRSPRAPTHSFKKPIVAKKPGNKTGGLGARKLTSKPNESLYEQKPEELAPALPPVTENSTAKSKSHTSRFEYVENTPSAGSNSEENQVIGHVAPPKSSNFFGEFGMDSGYHKKSAPGPSKVQIEESSEARQKFSNAKSISSSQFFGDQASFEKEAQVSLQKFSGSSAISSADLFGHPTNSSNVDLSASDLINRLSFQASQDLSSIKNMAGETGKKLTSLASNIMSDLQDRILLLSTTGNDDLSKVEKKEASDLNREPPVATIITMLEVASMRCSKFIADLEGGVTFL

SEQ ID NO: 19081 - protein, 696 aa, Caulobacter crescentus CB15
MNPARFGCIAPRLIAIWVGQQRFARAPRRDYMASEAPHASAPDCAPASSDIPQQDGGSTNGHGHDLKGHGFFALALGSVGVVFGDIGTSPLYAFKEALAAASHDGVTRSEIFGVVSLALWALILIVTIKYVVFIMRADNKGEGGVLSLMALAQHAMGKRTTLVFVLGVAGAALFYGDAVITPAMSVLSAVEGLRTIPALEHGVTNEVVLLIATVMLLGLFFIQSRGTASVGKLFGPVCAVWFGVMFSLGLMNLAANPGILMAISPYYAVEFLAEHGLTGFIVLGAVFLTVTGVEALTADMGHFGRWPIQAAWLFFVLPCLAMNYLGQGAFALTTLETAQAAGKAMPELNWFFEMAPEALRLPLVLLAGAATVIASQAVITGAFSLTQQAIQLGLLPRLDVRRTSETQSGQIFVPQLNTMLLLGVLAIMFTFQTSSALAHAYGLAVTGTMIVTTCMAFIVMRKLWKWSMPMALLFLVPFLALDITFLSANALRFFSGGWLPVLIGAALFTIMATWVRGSQILTDKTRRDSLPVADLMDILRARAPHRAPGTAIFLTSDPDMTPVALMHNLKHNKVLHERNVILTVRTAETPRVSEEERVKIEKVNDDFKKVVVNYGFMESPNIPKALAVCRKQGLKFDIMATSFFLGRRSIVPSANSGMPLWQDRLFIYLMRNAANPTDFFKIPPGRVVELGAQVTV

SEQ ID NO: 19082 - protein, 111 aa, Zea mays
KADAWTALWTISLHKIFAAIAMGIALLRMLPNRPLLSCFAYAFAFAISSPVGVGIGIIIDATTQGRVADWIFAVSMGLATGIFDLRRNQPPPEVPNNAALRVSHQVRCPIS

SEQ ID NO: 19083 - protein, 459 aa, Rhodobacter capsulatus
MLCPGRGATPSLPIPPRAPTGMVSTPLFPAHRPQATAGPTRKERQMPALDHPASAMLDLDSARRLACGLVAPIGDSETLDLAQAAGRTSATSLRAEIALPRAARSAMDGFALRTADLAAALTLPVAGTVAAGMQAPPLPDGAALRIFTGAQIPAGADAVVPVEEVTETGAEVQLTAAPAPGSHIRAVGSEQPLGGLLLRRGTRIRAHHIGLLASNGVAEVAVVRRPRLAILSTGDELHRPGAEAASRDTMPDVNRPMLIALAQGAGAEVDDHGILPDDAEATVAKFASLQGRYDLIVTTGAVSMGGRDHLRPALIAAGGQIDGWKVALKPGKPVMFGRLGNAAVTGLPGNPFSAMVGFTLFVSAQIARLKGAVPAPLFHCAGRAGFDWTRKPDRAEIFPIRLGNREIDGLPVVHRLGEGTSATLFPLAEADGLGFVPAETARVSVGTPICWQTFEAGAR

SEQ ID NO: 19084 - protein, 499 aa, Lotus japonicus
MDIISFLYYSLFYVALFAIIKLFLGSRKFKNLPPGPTSLPIIGNLHHLKRPLHRTFRALSEKYGDVFSLWFGNRLVVVVSSFADVQECFTKNDVVLANRPRFLSGKYIFYNYTTLGSTSYGEHWRNLRRITSLDVLSNHRINSFSPIRRDETTRLIRKLAEDSAKNFSEVELTSRFFDMTFNNIMRMISGKRYYGEDCDMTELQEASEFRDMVTELLQLSGANNKADFMPILRLVDFEGLEKRVKGISSKTDRFLRGLLQEHRDKKQRTANTMIDHLLTLQESQPEYYTDQIIKGLALAMLLAGTDSSAVTLEWSMCNVLNYPEVLEKIKAELDTHVGQDRLVDESDIPKLTYLKNVINETLRLYTPAPLLLPHSASDDCTIGGYKVPRDTIVLINAWALHRDPQLWTEATTFKPERFDKKGELEKLIPFGLGRRACPGELLAIRAISMTLALLIQCFDWKRVSDEEIDMGERDGFVLMKSIPVKAMCKSRPVINNVFK

SEQ ID NO: 19085 - protein, 163 aa, Methanosarcina barkeri
MLLTIRKELDLYANVRPVKPLPGITGVTGRNDFDFIIVRENTEGLYSGIEEIGPELSWTKRVVTRKGSERIAEYACKLAKKRKNKLTIVHKSNVLKSDKLFLDVCRQTASANGVEYEDMLVDSMAYNLIMRPERYDIVVTTNLFGDILSDMCAALVGSLGLVP

SEQ ID NO: 19086 - protein, 211 aa, Asarum caudigerum
NRQVTYSKRRNGLLKKAYELSVLCEAEVALIVSSSRGRLYEYANNSVRTTIDRYKKASDSSNPASVSETNSQYYQQEATKLRQQIDILQNANRQLMGESISAMNVKQLKQLETRLEKGISRIRSKKNELLFAEIEYMQKREVELRNDNIYLRGKIVENERAQQNMNMLPGGGGYEVMSQHPSYDSRNYLPVNLLEHNQHFSHQEPTALQLG

SEQ ID NO: 19087 - protein, 525 aa, Streptococcus thermophilus
MASKRLRHVLKVFSSVGLLFYREKHLPQDQQTTPVKLRQAFEQLGPSFVKIGQILSTRSDLLPEAYIRELSKLQSSVPPLNKEEVMTAIRQELPTDLSEVFVDFSKEPLASGSVAQTHRTRLLSGQEVIIKIQRPGIDDIVKEDIQLLIKLARHIPKHFISMVDVQEVLENLRETLIKELDFRNEAEAMKRFRANNKRVVCLGVPEVYDEFTTPHLIVEEYINGIPLNHYSQLLEAGYDLEDVGKKLMLSFIKQVFKDGYFHGDPHPGNLLVRDGKIYFIDFGIMGELEVGMRSSLNDILYSFTAQDVDGMTKAILSITQFDNGLNSAVLSQDVEKMLGRYSGVDIGSLSMTDLLEDLLTVFQKNHLKASSQITILEKASLEIEGIFREFAPNIDLMTLAKDYFLENMGPDMLKQALNKETILIELFYLLRNGKNIPRHLHQLLEQILNGRIVLNHDFINFSGRVKVFEKVLNNMVLALLTLAFLLSGALLSNKSDFQNLAWLFLGLGTVLALVTVGRIIFKKKG

SEQ ID NO: 19088 - protein, 358 aa, Campylobacter jejuni subsp. jejuni NCTC 11168
MQYKILENNRIASKGYAMLSKDAKFTPFEFSRHAIGDNDILIKILYAGICHSDIHTARSEWGEATYPCVPGHEIAGEVIAVGKNVSKFKVGDYAGVGCMVNSCGECDACKRSQEQFCENGKTIFTYNSCDVFHGNENTYGGYSNNIVVSEKFAVCVPKDAPMEKVAPLLCAGITTYSPLKFSNIKEGSSVAVAGFGGLGMMAVKYAVKMGAKVSVFARNENKKADALAMGVSSFYTSCDKNAVKERFDLIISTIPTPYNPAIYLDLLKFGGEMAIVGLPPHEVAPSISVITFVHKAGKKVYGSLIGGIAETQEMLDFSLKHGIYPETELITPQEIDKAYENLTSGKAKFRYVIDMTKE

SEQ ID NO: 19089 - protein, 403 aa, Zea mays
  unsure (1)..(403): unsure at all Xaa locations
GGEIARALCRLFVPRARHQAPPHTSQSREGRRSSGRFVAVASMTSAVSTKVENKKPFAPPREVHVQVTHSMPPHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMREKDLMPAHXLMFDGQDDKLFEHFSMVAQRLGVYTARDYADILEFLVDRWKVANLTGLSGEGNKAQDYLCTLASRIRRLEERAQSRAKKAGTLPFSWVYGRDVQL

SEQ ID NO: 19090 - protein, 675 aa, Salmonella typhimurium LT2
MKLAAFALTLIPGIAIASSWTSPGFPTFSTQETGRFTSHAALTKGTRALTLHIDQQCWQPSGAIKLNQMLSLKPCEGAPPQWRLFKDGDYTITVDTRSGTPTLLLSIKTEPERTAQLAYQCPVWDGSPLTLDVRQTFPEGTVVRDYYSGQTDTVQNGQITLQPADSHGLLLLERAETHAPAPFNWRNATVYFVLTDRFRNGDPTNDHSYSRHKDGMQEIGTFHGGDLRGLTSQLDYLQQLGVNALWISSPFEQIHGWVGGGTKGDFPHYAYHGYYTQDWTTLDANMGSEADLRALVDGAHQRGIRILFDVVMNHAGYATLADMQEYQFGALYLSGAERQKILGDRWTNWRPAAGQSWHSFNDYINFSDSAAWEKWWGKKWIRTDIGDYDSPGFDDLTLSLAFLPDIKTESTTPSGLPAFYANKPDTKAKFIEGYTPRDYLTHWLSQWVHDYGIDGFRVDTAKNVELPAWQQLKTQASAALREWKQANPDKALDNSPFWMTGEAWGHGVMKSDYYRYGFDAMINFDYQEQAAKAVDCLAEMGPVWQQMTDKMQDFNVLSYLSSHDTRLFREGGDKAAELLLLSPGAVQIFYGDESARPFGPTGSDPLQGTRSDMNWQDVSGKSAAAVAHWQRISQFRARHPAIGAGQQTTLTLKHGYGFVRQYGDDTVMVVWAGRR

SEQ ID NO: 19091 - protein, 309 aa, Streptococcus pneumoniae
GFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEM

SEQ ID NO: 19092 - protein, 392 aa, Zea mays
NQTYMQNKAYFCKVNPDDLVFGGWDISSMNLADAMTRAKVLDIDLQKQLRPYMESMVPLPGVYDPDFIAANQGSRANNVIKGTKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSPRIQLKPEGTDKFHSFHPVAPILSSLPKAPLVPPGTPVVNALANQRAMLENIMRACVGLAPENNMILESK

SEQ ID NO: 19093 - protein, 361 aa, GIBBERELLA ZEAE PH-1
MPSTTHSEFGTNTEAIDVAKAFSDGIHGETILITGVNRGGIGFSTAQAFIKSTQDPALIIIANRTLAKANDSIDNLKAEFPNVNYRFLEVDLSSQTSVRKAAEQVISWSDVPTIDLVINSAGVMGINERTITEDGLEMHLATNHIGHWLLTCLIMPKLIKAAEDKPKGSVRIVNITSASPMRSAMRWSDMNFDKKNKDLPQEEQPVYQFLKLWGYTDVEDAAYLPLDGYNRSKVANVLFGIGATKRLFNKYGILSLSAHPGVIWGTELGRNFPQATIDAAKKMGEKGLYTLKSLGAGASTGLVAALDPKLAVDVCEGEGNHGSYLVDCQISDQANPLAVSSSEAERLWEVSEKATGSEFAW

SEQ ID NO: 19094 - protein, 384 aa, Oryza sativa
  unsure (1)..(384): unsure at all Xaa locations
FFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPXADYAWRIVLMFGAXIPALLTYYWRMKMPETARYTALVAKNAKQAAADMTQVLNVEIVEEQNKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFF

SEQ ID NO: 19095 - protein, 426 aa, Neisseria meningitidis MC58
MENSLKEAALKFHEFPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 19096 - protein, 575 aa, Oryza sativa
MASPLLLLLPLAVSSLLLPFAAAARVFSVADYGAAGDGARYDTGAIQAAVDACAAAGGGRVLLPAPGDYLTATVHLRSRVVLDVAPGARLLGGTRQADYPPESRRWYVVLAENTTGAGVTGGGEINGQGGAFVVTPNPQKNIMVSWNATGDCEGDECRPRLVGFIDSKDVTIHDITLNQPAYWCLHIVRCDNTMIHNVSIYGDFDTPNNDGIDIEDSNNTAITHCHIDTGDDAICPKSTTGPVYNLTATNCWIRTKSCAIKFGSASFFDFKKLVFDNITIVDSHRGLGMQIRDGGNVSDVVFSNIKMSTRYYHPLWWGRAEPIYITTCPRHPDSKEGTISDIQFINISSVSENGVFLAGSKHGLLRNLKFKNVDLTYKRWTNYSGGLYDYRPGCQKMVKHRTGGMMLEHISGLEIDNLSNSSPFSPKSAATSLRSPHHPPISTTTTTTRARAPTGGASMRAISSAAGGMLRARLRGGARVRGGGGHGEGGGRWTTPGHEEQPKGYLFNRPPPPAGESRKWEDWELPCYVTSFLTVVILGVGLNAKPDLTLETWAHQKALERLQQQELASGEAQAE

SEQ ID NO: 19097 - protein, 239 aa, Glycine max
  unsure (1)..(239): unsure at all Xaa locations
DLVDVPPVFVLGVIGGILGSLFNLILSKVLRIYNFINEKGTIFKILLACLISIFTSCLLFGLPWLTSCRPCPPDPSEPCPTIGRSGIYKKFQCPPNHYNDLASLIFNTNDDAIRNLFSKNTDDEFEFKSVFIFFITCFSLSIFSYGVVAPAGLFVPVIVTGASYGRIVGMLLGKKDSLSHGLYAVLGAASFLGGSMRTTVSLCVIXLELTNNLLLLPLIMMVLFISKTVADAFNAXIYD

SEQ ID NO: 19098 - protein, 201 aa, Escherichia coli CFT073
MIRSKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 19099 - protein, 384 aa, Lupinus luteus
MQIQTCYSIRIQILPLPWARRTGRHKMLPPIAAISATPPSLKSPKTHSMPPEKIEIFKSLESWASQSVLPLLKPVEQCWQPQEFVPDSSLPFGDFTDQVKALRDRTAELPEEYFVVLVGDMITEDALPTYQSMINNLDGVRDETGSSPSPWALWTRAWTAEEKRHGDLLRTYLYLSGRVDMKKIEKTVQYLIGSGMDPGTENNPYLGFVYTSFQERATFVSHGNTARLAKEGGDPVLARICGTIAADEKRHENAYSRIVEKLLELDPTGAMVAIGDMMQKKITMPAHLMYDGEDPKLFDHFSAVAQRMGVYTANDYADILEFLIGRWRLEKVQDLKDEGKKAQDFVCGLAPRIRRLQERADERARKMKPHAVKFSWIFNKEIIL

SEQ ID NO: 19100 - protein, 349 aa, Xylella fastidiosa Temecula1
MFINAYGAHAGDKPLESMQIARRAPGAHDVQIDIHYCGVCHSDIHQVRAEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDPFLTLLKRDGTLTLVGAPVTPHPSPEVFNLIFKRRSIAGSLIGGIAETQEMLDFCAEHGIVADIELIRADGINEAYERMMKGDVKYRFVIDNATLAA

SEQ ID NO: 19101 - protein, 564 aa, Pseudomonas aeruginosa PAO1
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTQGEGAVLPALGDIREVSKRIAVAVAKQAQAEGKALHTSDEVLNDAIEANFWFPRYRAYRRTSF

SEQ ID NO: 19102 - protein, 728 aa, Neurospora crassa
MLTLFSSFDPSASSNLQHHNNNSQKRAFANGNGQGLPRFSICFMAAELLDSVPDPVLSDLDQKEAVAGLQGYQHPAVSANPDPVEAELEAKELSKYLLAKSFFDCKEFDRCASVFLPDSLLSGLLSTKATDATTPKGKAKASSAPPYEQALPSLSQKSLFLALYAKVISGEKKKNEESEMIMGPQDLGTIKNSHLVVVSRFLERWFAERKAEDSDLPPSQGFLEYLYGMVMVKEKNEDAALDYLLNSVHLFPWNWGAWLELTNLISGVEQLNKITPVLPQNIMSFIFYANTAVNLYQQGQDLAASVNDLLKLFPTSSFILTCRALLNYHSKDLYTAEQNFSNLLALHPHRLDSLDHYSNILYVLNMRPKLAFLAHLCSSIDKFRPESCVVIGNYYSLLSLHEKAVQYFRRALTLDRSCLSAWTLMGHEYVELKNTHAAIESYRRAVDVNRRDYRAWYGLGQTYEVLEMNSYALYYYKKAAGLRPWDGKMWQAVGSCLQKMGKDRDGIKALKRALLADSYYDSTLSSFGSAGPADRMAQMDPEVLLQIASMYDRLGEVEEARAYMELCVAQEDGGATDNADASAVCTSNPGESFVVHGDSPGSDGDAEGGYEGRGGAGQGEGTGVTVATSKAPMIRIGSNGGGGPKLRRVPRSQRYYENISTIPPLTDQGSGIYEDPSQESDDDDDDDDENGGNDRHDDWSGEDYLTDGYDDDDVDDDDDDNGGAPTNA

SEQ ID NO: 19103 - protein, 105 aa, Zea mays
AVDKAQPNPRLCFLLRAALHLHWLLLVTSKNNKALQMSVQDANMSSDTDMSKVFEDRTFVSSILNSLPGVDPNDPSVKDLLASLHSQGEQEKKEDTSDKTEDEKN

SEQ ID NO: 19104 - protein, 245 aa, Enterococcus faecium
MNDLSEKVIVIMGASSGIGEATTKLLAEKGAKLVIAARREDRLKAIKESLPEAELYIQTADVRDFAQVQAVIDLAMEKFGRIDVLYNNAGIMPTAPLVEGHRDEWQNMLDINIMGVLNGISAVLPIMEKQKSGHIISTDSVAGHVVYPDSAVYCGTKFAVRAIMEGLRQEQRQNNIKSTIISPGAVQTELYQTISDKKAALELHEAQKEWGLTSEDIASAVAFAIETPDRMSVSNMIIRPTTQEV

SEQ ID NO: 19105 - protein, 431 aa, Prochlorococcus marinus str. MIT 9313
MIDSLDLVIDTIVAREVLDSRGNPTVEAEVLLEAGAIGRAIVPSGASTGAHEAHELRDGDSRYLGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASSFRESLRMGAEVFHTLKGLLSAQGLSTAVGDEGGFAPNLANNDAAGDLLIQAIEKAGYSPGKDISLALDVASTEFYQDGCYAFGGGRYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGSQAVYAGATGQGPRGRS

SEQ ID NO: 19106 - protein, 722 aa, Triticum aestivum
  unsure (1)..(722): unsure at all Xaa locations
PRLRLESLDYEIVENDLFKQDWRSRKKNQIFQYVVLKWALVLLIGLLTGLVGFFNNLAVENIAGFKLVLTGDLMLQKRYFTAFLAYGGCNLVLGATAAALCAYIAPAAAGSGIPEVKAYLNGVDAYSILAPSTLFVKIFGSILGVSGGFVLGKEGPMVHTGACIANLLGQGGSRKYHLTWNWLKYFKNDRDRRDLITCGAAAGVAAAFRAPVGGVLFALEEAASWWRSALLWRTFFTTAVVAVVLRALIEFCRKGKCGLFGQGGLIMFDLSSNVPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNDDAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVXDEPPVSEAPELVGLVLRSHVLVLLSGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 19107 - protein, 337 aa, Mucor racemosus
MVVQVGINGFGRIGRIVLRATESNKDVQVVAINDPFIPLDYMVYMLKYDTVHGRFDGSVEAKDGKLVVNGHAIAVSAERDPTSIPWGSAGADYVVESTGVFTTTEAASAHLKGGAKKVIISAPSADAPMFVCGVNLEAYKSEYKVISNASCTTNCLAPLAKVINDNFGIADGLMTTVHATTATQKTVDGPSHKDWRGGRAAAANIIPSSTGAAKAVGKVIPALNGKLTGMAFRVPTPDVSVVDLTVNLSKGASYDEIKQAIKKASETTMKGVLGYTSDAVVSSDFVGEVCSSVFDAAAGIQLTPTFVKLIAWYDNEYGYSNRVVDLLVHAAKVDGAL

SEQ ID NO: 19108 - protein, 381 aa, Arabidopsis thaliana
MANNEDSNSNGLDSFDAVKQRFKDRSKKVVQTRELLSKQAVQTREILSKQAVKIAKQAEEHERFINKVTHLVGVLGFGGFCFLLGARPQDIPLVYCFFYVIFVPLRWIYYRFKKWHYYLLDFCYYANTIFLVDLLLYPKNEKLFMVCFSFAEGPLAWAIIVWRCSLVFSSPDKIVSVLIHLLPGLVFFTIRWWNPATFAAMHPVGTDRRVSWPYVEDKAYLFTWLFLVPLVVYTLWQVLYFLIVNVLRRQRLLRDPEVMTSYRELSKKAEKANNKLWQLSGLLGDQNRIWMYILFQAIFTVATMALTVPIFLSYRLHVIFQILKISAAVWNGGSFLLEVMPRQVIQKEKKKKAEMQPIEEQILHHEAVSHPTENEPKSTET

SEQ ID NO: 19109 - protein, 479 aa, Methanosarcina mazei Goe1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 19110 - protein, 385 aa, Triticum aestivum
  unsure (1)..(385): unsure at all Xaa locations
RAHCTVALAQAHCTKAPPVNGTDDQAVLDAEHELWATTFSYIKSMALKSALDLRLADAIHHHGGAATLPQIAXRVAVHPSKIPCLRRLMRTLTVSGVFSXRPAAGRRRSCCPREQRHLPRRPRRRALLRPLASRPASSSARRAPLPLLPLLLPPDRRAARPGIAAWFQHPLPDPCLFEQAHGEALWEMSGHDAALDALINSAMVSDSRFIVDIAVRESGDVFRGISSLVDVGGGLGAAAQVISEAFPHLQCSVLELEHVVSKAPAGTSVKYVAGDMFESVPPADAVFLKSVLHDWDDEKCVKILKTCRKAVPPREAGGKVIIIDIVVGADKKHGEVHALLDLYIMFINGVERDEQEWSKIFLEAGFSDYKIIPVLGFRSIIEVYP

SEQ ID NO: 19111 - protein, 227 aa, Zea mays
MLFLRCQPRVSSPSASASAPPFRPRVGVAAPLGVRVTGGRRGQAVVAMASADARLAGIASSIRVIPDFPKPGIMFQDITTLLLDPKAFRDTIDVFVERYKDQGITVVAGVEARGFIFGPPIALAISAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 19112 - protein, 583 aa, Glycine max
  unsure (1)..(583): unsure at all Xaa locations
LGFKAFEFCVNGHPLSYEELVTLQNCPNPPKKLKPGTYWYDKVSGLWGKEGQKPSQIISPHLNVGGPIQQDASNGNTQVFINGREITKVELRMLQLAGVQCAGNPHFWVNEDGSYQEEGQKNTRGYIWGKAGTKLVCAFLSLPVPSKSSNSLGEQXLSLASRTMPDYLEHGIVQKLLLVGGSGSGTSTIFKQAKILYKSVPFSEDEHENIKLTIQSNVYAYLGMLLEGRERFEEESLGDLKKRQSSVHDTTGTSPKLDEKTVYSIGPRLKAFSDWLLKTMVSGKLDAIFPAATREYAPLIEELWNDAAIKATYERRSELEMLPSVASYFLERAVKILRTDYEPSDLDILYAEGVTSSNGVACVEFSFPQSVSEETVDTTDRHDSLVRYQLIRVHARGLGENCKWLEMFEDVEMVIFCVSLTDYDQFSVDGNGCLTNKMILSRKFFETIVTHPTFEQMEFLLILNKFDLFEEKIEQVPLTKCEWFSDFHPIISRNRPNGNSNSINNNPSLGQLASHYIAVKFKRLYSSLTGRKLYVSPVKGLEPGSVDASLKYAKEILKWSEERPNFSLSEYSMYSTEASSFSH

SEQ ID NO: 19113 - protein, 316 aa, Zea mays
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTPEQHRALQIYPEAAHLQQTHPDNNI

SEQ ID NO: 19114 - protein, 127 aa, Triticum aestivum
  unsure (1)..(127): unsure at all Xaa locations
MPTSEHDESAAPETSENSDHVKHLNIKVTDNNNEVFFKIKSTTPLKKLMDAFCERQGKSPASVRFLHEGSRVQPTRLPXSINIEDGDTLESTSGKSGGASSSDGYELHGYHSRVLDKDGVFKRKWIQ

SEQ ID NO: 19115 - protein, 376 aa, Magnetococcus sp. MC-1
MGNVVRLTAYSSEILAMDSIRIQTEDFSAQDEVDALLKANPKIGGVVTFLGTVRDFTSSDAVTALELEHYPGMTERELERIVAAAHAQFPVEAIRVIHRVGYLEVGQNIVLVIAAGRHRAESFEACRYVIDHLKVRATLWKKEISPSGSRWVESCPGCEAAASQWADLKQGAKHTHAVSAVEADHHHHGDHQHGDHQHGGGPQHGHAEHRDHGAAVASWPGLRVGIVTLSDSRTLATDKSGDALEGAVLSYGGRVVQRTLLADDQAVLAACLCTWADEQGVDVILTTGGTGPSPRDITPEATRQVCNRELPGFAELIRAAGMQQTRNAVFTRGVTALRGQTLVVNLPGSTRGALHSLQAVADLIPHALRMAAGAGH

SEQ ID NO: 19116 - protein, 364 aa, Hypocrea jecorina
MKGLILVGGFGTRLRPLTLTLPKPLVEFCNKPMIVHQIEALVAAGVTDIVLAVNYRPEIMEKFLAEYEEKYNINIEFSVESEPLDTAGPLKLAERILGKDDSPFFVLNSDVICDYPFKELLEFHKAHGDEGTIVVTKVEEPSKYGVVVHKPNHPSRIDRFVEKPVEFVGNRINAGMYIFNPSVLKRIELRPTSIEKETFPAMVADNQLHSFDLEGFWMDVGQPKDFLSGTCLYLSSLTKKGSKELTPPTEPYVHGGNVMIHPSAKIGKNCRIGPNVTIGPDVVVGDGVRLQRCVLLKGSKVKDHAWVKSTIVGWNSTVGRWARLENVTVLGDDVTIGDEIYVNGGSVLPHKSIKANVDVPAIIM

SEQ ID NO: 19117 - protein, 222 aa, Glycine max
  unsure (1)..(222): unsure at all Xaa locations
AAEEDHAERDYDSEDQTHHNHPNSQPHVEAEVLSDHGVQISQFPAVIKRSVNRPHSSVTAIVALERALESGDNKAQSALDAPILENVSHGQLQALSSVPSDNFALDCDSSFVITPPPILEGXGVVKRFGTKVLVVPMXHSDWFSPATVHRLERQVVPHFFLGKSPDHTPXEKYMECRNCIVAXAMEDPGMRITVSDVRVCWLGLWLKDLTRIGRFLDHWXNY

SEQ ID NO: 19118 - protein, 358 aa, Burkholderia fungorum
MVSHPHVRQPQVQRRKKPGRQDRLSHDGRVLRGPGPRAAQWRGRRIRIRGADKMSNPGVNSEFPLFVSAGDILTDLVRTGPSQWLSRPGGAGWNVARCVARLGLPTACAGSLGVDNFSDELWNASVAAGLDMRFMQRVERPPLLAIVHQTHPPAYFFMGENGADLAFDPARLPAGWASHVKWAHFGCISLVRQPLGNTLAALAAQLRSQGVKISFDPNYRNLMEHGYEPTLRKMAALADLIKVSDEDLRLLFKTDDEASALAQLRAMNPAATVLVTRGPETAVLIDGAVVTEARPPRVEVVDTVGAGDASIGGLLFSLMTAPQRAWPEHLAFALAAGAAACRHAGAHAPSLDEVVALL

SEQ ID NO: 19119 - protein, 131 aa, Prochlorococcus marinus subsp. marinus str. CCMP1375
MKQILSQKEQFINNLDEKYSQRFIELDPSGYFLIKVSHETNELIVEHFSNNIDETGLATDPETGEPLKCNDNKERSPIKVFKGKSAKEIGIQITEGHVPKPLTKLDHALYLGRELQKAEFCLTNGKPYVQD

SEQ ID NO: 19120 - protein, 344 aa, Schizosaccharomyces pombe
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 19121 - protein, 477 aa, Gracilariopsis tenuifrons
KKERYESGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAVAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNESRDYVAEGPEILRDAAKTCGPLQTALDLWKDITFNYTSTDTADFVETPTANV

SEQ ID NO: 19122 - protein, 238 aa, Halobacterium sp. NRC-1
MKAVVLAAGEGTRLRPRTADLPKPLVEVNGKPILTHCFEILLDLGIDDVVVVVGYEKDKIIDRYGDSFRAIDIEYAHQSERLGLAHAVLTAEPYVDSDFVVLNGDNIYSANFSEVLAHHTESGADITFPVEEVSTEEATSGAVCELDDDRAVTGLVEKPAEPPSNYAPTAFYVLPPAIFPACRVIRPSERGEYELADAIDLLIYSGYSVETQPFEGWKVNVNTEADITRAEQLLHSGQ

SEQ ID NO: 19123 - protein, 496 aa, Pseudomonas aeruginosa PAO1
MTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 19124 - protein, 465 aa, Gelidium pusillum
AKMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 19125 - protein, 123 aa, Oryza sativa
  unsure (1)..(123): unsure at all Xaa locations
PHHNNHYNSYMNFMHQNEEANYFISGYYPGKHAPRYNIPFGTLTNRHKKVESANENNFKQTGERFRSWDPARIDPVIKKRXIDTLCDPALTHEIRSIWLSYWSEAHRYLGQKLSSRLSSKPSM

SEQ ID NO: 19126 - protein, 469 aa, Vibrio parahaemolyticus RIMD 2210633
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDYMRSTGIADTVLVGPEPEFFLFDDVKFSNDMSGSFFKIDDIEAAWNTGSDIEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARAINAFANPSTNSYKRLVPGFEAPVMLAYSARNRSASIRIPVVPSPKARRIEARFPDPAANPYLAFACLLMAGLDGIKNKIHPGEAMDKDLYDLPAEEAAEIPKVAESLEVALNALNEDREFLTAGGVFSDDFIDSYIALKSKDVERINMATHPLEFELYYSV

SEQ ID NO: 19127 - protein, 744 aa, ASPERGILLUS NIDULANS FGSC A4
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAQALPFVIGTKRSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 19128 - protein, 345 aa, Lactococcus lactis subsp. lactis
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLVIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGAAMIEKAVTQTFTDGILTKDLGGTATTKEMTEAILKNCQ

SEQ ID NO: 19129 - protein, 309 aa, Triticum aestivum
  unsure (1)..(309): unsure at all Xaa locations
NPTKGNKSWSSTAVAAALELVDPPGCRNSAPPNPISSPPLPSARPNPIRSPPPSPWGRKFFVGGNWKCNGTVEQVESIVNTLNAGQIASTDVVEVVVSPPYVFLPTVKAKLRPEIQVAAQNCWVKKGGAFTXGEVSAEMLVNLGVPWVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 19130 - protein, 220 aa, Streptococcus pyogenes MGAS315
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALHD

SEQ ID NO: 19131 - protein, 542 aa, Sinapis alba
MNTFTSNSSDLTSTTKQTLSFSNMYLLTTLQAFVAITLVMLLKKVLVNDTNKKKLSLPPGPTGWPIIGMVPTMLKSRPVFRWLHSIMKQLNTEIACVRLGSTHVITVTCPKIAREVLKQQDALFASRPMTYAQNVLSNGYKTCVITPFGEQFKKMRKVVMTELVCPARHRWLHQKRAEENDHLTAWVYNMVNNSDSVDFRFVTRHYCGNAIKKLMFGTRTFSQNTAPNGGPTAEDIEHMEAMFEALGFTFSFCISDYLPILTGLDLNGHEKIMRDSSAIMDKYHDPIIDARIKMWREGKKTQIEDFLDIFISIKDEEGNPLLTADEIKPTIKELVMAAPDNPSNAVEWAMAEMVNKPEILRKAMEEIDRVVGKERLVQESDIPKLNYVKAILREAFRLHPVAAFNLPHVALSDATVAGYHIPKGSQVLLSRYGLGRNPKVWADPLSFKPERHLNECSEVTLTENDLRFISFSTGKRGCAAPALGTALTTMLLARLLQGFTWKLPENETRVELMESSHDMFLAKPLVMVGELRLPEHLYPTVK

SEQ ID NO: 19132 - protein, 488 aa, Petalonia binghamiae
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATVEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAASTCGPLKAALDLWKDITFDYTSTDTPDFVEVATGSR

SEQ ID NO: 19133 - protein, 646 aa, Oryza sativa
MADSPRRRNGLLRDQVQLVKRKDTNRYEIVRFPDPLSFEKGFFVMIRACQLLVQHNEGMIFVGVAGPSGAGKTVFTEKVLNFMPGVAVISMDNYNDASRIVDGNFDDPRLTDYDTLLENIHGLKEGRSVQVPIYDFKMSCRTGYRTVDVPSSRIVIIEGIYALSEKLRSVLDLRVSVTGGVHFDLVKRVLRDIQRAGQEPEEIIHQISETVYPMYKAFIEPDLQTAHIKIINKFNPFSGFQNPMYILKSPRTITPTDIKVALGEDHTESIEETYDIYLLPPGEDPESCQSYLRMRNREGKYNLMFEEWVTDNPFIISPRITFEVSVRLLGGLMALGYTIAAILKRKSRVFSDGKATVKIDWLEQLNRNYIQVQGRDRNHVKFVAEKLGLDGSYIPRTYIEQIQLEKLINDVMALPEDLKTKLSIDDELVSSPKEALSRVSADKRNKHLKSGLSHSYSTHGDKNIVKLSKLTETNRRFGSGRAPEPPAINQGAITQLSEQISTLNERMDEFTSRVEELNCKFAIKKSSTSQQNLALPNETCNGSAPTNLFVSHLGNGTLIPHSSSSNQLLKESPIVDEINAISRGQRQVIHQLDNLTSLLHEHLALTRQGNAVRRNGILEMDMSICPLIALTIGGFGYLVFKSLNRS

SEQ ID NO: 19134 - protein, 202 aa, Glycine max
MGFNILRTTSISTPISSSKSKPIFSTLLRSSPSTIFPPKSVTPTTLFVSATPFFTLHPKLGFRGGIVAMAAPGSLRKSEEEWRAILSPEQFRILRQKGTEFPGTGEYDKFYDEGVYNCAGCGTPLYRSLTKFNSGCGWPAFYEGIPGAINRNPDPDGMRTEITCAACGGHLGPVFKGEGFPTPPNERHCVNSISLKFAPAHF

SEQ ID NO: 19135 - protein, 290 aa, Lactarius deterrimus
LLDPRVKVLAVSDPFIDLQYMVYMFKYDSVHGRFKGTVEIKDGKLVIDGHPITVFQERDPANIQWGSVGADYVVESSGVFTTVDKASAHLKGGAKKVIISAPSADAPMFVVGVNLDAYDSKYTVISNASCTTNCLAPLAKVINDKFGIVEGLMSTIHATTATQKTVDGPSNKDWRGGRAVNGNIIPSSTGAAKAVGKVIPALNGKLTGLAFRVPTNDVSVVDLVVRLEKEATYDEIKLAVKEAADGPLKGIIEYTDDLVVSTDFIGSTASSIFDAGAGIQLNKNFAKLIS

SEQ ID NO: 19136 - protein, 494 aa, Bacillus cereus ATCC 14579
MLKTNIELKPKVEAFLNEEIKMFINGEFVAAIGGKTFETYNPATEDVLAVVCEAQEEDIDAAVKAARSAFESGPWAEMTTAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLHYIEQGKKEGATVAAGGERALEKGYFVKPTVFTDVTDDMTIVKEEIFGPVVVVLPFDSTEEVIERANNSSYGLAAGVWTQNIKTGHQVANKLKAGTVWINDYNLENAAAPFGGYKQSGIGRELGSYALDNYTEVKSVWVNIK

SEQ ID NO: 19137 - protein, 175 aa, Oryza sativa
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 19138 - protein, 488 aa, Fusarium sp. IFO 7772
IVYYPEKGKLPTSSDNAIKLSTSAGTVIGQLFFGAMADIVGRKRMYGLELILIIFATLAQALTAGSPSVSIIGVIIFWRVLMGVGIGGDYPLSSIITSEFATTKWRGAMMAAVFAMQGIGQLVAALVMMFLTLGFKSSLETAADTKSCTGGCQVSVDKMWRTLIGFGAVPACIALYYRLTIPETPRYTFDVARDVEQADEDVKAYMTGKREGETDEVARAQVHQGAKANLQVPKASFRDFLKHYSKWKNASLLLGTAGSWFCLDVAFYGLSLNNGTILKVIGYSAKNTHSVYEYLYNTAVGNIIIVLAGAVPGYWVSVATIDTLGRKTIQLGGFIILTILFVVLGFAYNHIPSNGLLAIYVLAQFFFNFGPNTTTFIVPGEVFPTRYRSTSHGISAASGKIGSIIGQGAISILRTRGATETNEAPWMDHVLEIYALFMLLGVFTTLLIPETARKTLEELSGDDDFANTHDDHALGHESHSGKPERTSV

SEQ ID NO: 19139 - protein, 310 aa, Staphylococcus schleiferi
GFGRIGRLAFRRIQDVENIEVVAVNDLTDDDMLAHLLKYDTMQGRFTEEVEVIDGGFRVNGKEAKSFSEPEPAKLPWGDLGVDVVLECTGFFTDKEKAEAHIQAGAKKVLISAPAKGDLKTIVYNVNHDDLDGSETVVSGASCTTNSLAPVAKTLHDEFGIVEGLMTTIHAYTGDQNTQDAPHRKGDKRRARAAAENIIPNSTGAAKAIGLVIPEIAGKLDGGAQRVPVATGSLTELTVVLDKEVTVEEVNKVLKAATNEPFGYTEDEIVSSDVVGMTYGALFDATQTRVMTVGDRQLVKVAAWYDNEMS

SEQ ID NO: 19140 - protein, 525 aa, Cucumis melo
MASSMAAVGVLRLPTSSSSSSSSSNGGTNRARRTSLRSLSFGASQISGDKIDFRGFGLGSRRVSGGRVAPSIVSPKAVSDSKNSQTCLDPDASRSVLGIILGGGAGTRLYPLTKKRAKAAVPLGANYRKIDIPVSNCLNSNISKIYVLTQFNSASLNRHLSRAYAVIWWLQNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFTFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 19141 - protein, 476 aa, Novosphingobium aromaticivorans
MTAYPSLHMIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 19142 - protein, 360 aa, Rhodobacter sphaeroides
MDIRTHRIAAIPGDGIGIEVVAAGLEVLEALADRDGGFRFDVESFDWGTDRYRRTGAFMPEDGADRLRGFDAILFGAVGAPDVADHLTLWGLRLAICQPLDQYANVRPTRMLPGIRSPLRHVGESELDWVIVRENSEGEYAGQGGRSHPGLPLEVATDVSIFTRAGVERIMRFAFRLAQSRPRKLLTVVTKSNAQRHGMVLWDQIAGEVAREFPDVRWDKMLVDAMTVRMVQKPASLDTIVATNLHADILSDLAAALAGSIGVAPTANLNPERDTPSMFEPIHGSAFDITGRGIANPVATFWTAAMMLEHLGEAEAAGRLMTAVGRVTADEDLHTPDLGGRATTRQVTDALIAALRGRNA

SEQ ID NO: 19143 - protein, 493 aa, Methanosarcina barkeri
MVQEYKLFIGGEFKDSSTGETFEDINPATLENLATIQVAGAEDVDMAVEAAEAGFRLWNEVPAAKRAEVLFRAARILQERKEELSVLMTKEMGKVLPETRGDVQEAIDITNYAAGEGRRMLGETTTSELKEKFCMTILRPIGVVGLITPWNFPIAIPAWKVMPALVAGNAIVFKPASDTPLLAFKLIEVLSEAGLPPGVINLVTGPGGTVGKAVVQHPRIKAISFTGSLDTGKWIMEECSKTMKRVSLELGGKNPVIVMDDADLELALEGVLWGAFGTTGQRCTATSRLILHEKIKDEFIKRLLAKAKALSIGGGLLPETDIGPVINKAQLEKIERYVKIGKEEGATLLYGGNRIDPGLPGYFFEPTIFTDVRPDMRIAQEEIFGPVLGIFTVSDLEEAITLANSTKYGLSSAIYTGNIGNAFRAIEKVEAGITYVNAPTIGAEVHLPFGGVKGTGNGFREAGTEAVKEFSEVKAVYIDYSGMLQKAQIDSAE

SEQ ID NO: 19144 - protein, 244 aa, Zea mays
  unsure (1)..(244): unsure at all Xaa locations
YTRGLPGSSGHVIGVPVISXAYGIEEEASRDPSSLARAATXDADHLAVSFTHPSPYASFGYKHSSSNHWVSKLSRRAQGFREHVTLGPKLSETVKGKLSLGARILQAGGVERVFRQAFSAADDDKQGERLLKALQCYIYTTGGPIAGMLFVSTRKVAFRSDRPVTVVTSSSSPAGVVRGTARVTYKVVVPLRRIRRVRPSENVHRPEEKYIHVSTVDGFEFWFMGFVSYQRSCKYMQQAVSEMR

SEQ ID NO: 19145 - protein, 312 aa, Blastochloris viridis
NGFGRIGRLAFRRIQDVEGLEVVAVNDLTDDDMLAHLLKYDTMQGRFTGEVEVIEGGFRVNVKEIKSFDDQMLGKLPWGDLDIDVVLECTGFYTDKEKAQAHIDAGAKKVLISAPAKGDVKTIVFNTNHDALDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDKEWG

SEQ ID NO: 19146 - protein, 243 aa, Agapanthus praecox
MGRGRVELKRIENKINRQVTFSKRRNGLLKKAYELSVLCDAEVALIVFSSRGKLYEFGSAGTSKTLERYQRCCYTSQDATIADREKQNWYQEVARLKAKFESLQSAQRHLLGEDLGPLSVKELQQLERQLEASLSQARQRKTQIMFDQMEELRKKEHHLGEINKQLKTKLEAEGENLRAIQGSWESDATNVGGGNVFSMHPSHSSAMECEPTLQIGYHQLVQPEGSLPRNSGGENNFMLGWVL

SEQ ID NO: 19147 - protein, 463 aa, Triticum aestivum
  unsure (1)..(463): unsure at all Xaa locations
MAAASFTAAKFLAPAAARSGGDRAPFPAPSAFSMRPLRHRPARRLSSVLAVSSDVLKAAPAAAAYPAVTREEALELYEDMILGRNFEDMCAQMYYRGKMFGFVHLYNGPSPPASGCIRPLPPXVVSTYRDHGQPLCTVHPSRAVMAQLFGKATGCWRXRGGSMHMFSEPHTLIGGCGFAVEGMPVPIAAAFAAKYRHEVLKQSSPDGLDVTLAFFGDGACNNGQFLVCLNMAQLWKLTIMIVVEIDIWGMGIGGLKFTSDPEIGKKGPAFGMPGVRVTRMDVVNVREVGKEAIDRARRGEGPTQVHYETXHLIGSSKTDLVEQRSPDEKSHYATRDPITSXWKKYIIVHNLEPAAEPERIEKEIDDVVEEAVDLADANALPPGPQVLANVFADPRAFGIGPDGKRRVEDPKPPQRTAHVEGPPPQKQLVYALFLMYYLSSYPQPLVLSNPLSISCVVRGHISL

SEQ ID NO: 19148 - protein, 402 aa, Pseudomonas syringae pv. tomato str. DC3000
MADQGSPRRFARIDRLPPYVFNITAELKMAARRRGEDIIDLSMGNPDGATPPHIVEKLVTVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFAELEKAIRGSIPKPKMMILGFPSNPTAQCVELDFFERVVALAKQYDVLVIHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 19149 - protein, 54 aa, Glycine max; identical to SEQ ID NO: 8514

SEQ ID NO: 19150 - protein, 127 aa, Pichia pastoris
MTNWKAILTPAQYQVLRLGGTERPYTGQYVNFKKNGTYLCSGCQTPLYKSGTKFDSSCGWPAFYEALPGAVKRIEDNSLGMRRIEIRCSKCDGHLGHVFEGEGFDTPTDSRHCVNSISLKFQGEEEN

SEQ ID NO: 19151 - protein, 420 aa, Bradyrhizobium japonicum USDA 110
MSAVGNEPLARQALAFVLAGGRGSRLLELTDRRAKPAVYFGGKSRIIDFALSNAVNSGIRRIAVATQYKAHSLIRHLQMGWNFFRPERNESFDILPASQRVSENMWYVGTADAIYQNIDIIESHNARFIVVLAGDHIYKMDYEVMLRQHVDSGADVTVGCLEMPRAESSGFGIMHIDENGWIQEFLEKPADPPPMPGKPDVSLASMGIYVFDAKFLFDQLKRDAEDPSSNHDFGKDIIPYIVKNGRAIAHQFSTSCVRSGDDPRAYWRDVGTVDAYWAANIDLTDVVPELDLFDRAWPIWSYSEITPPAKFVHDEESRRGQAVSSLVSGGCIISGASLRRSLLFTGVRINSYANVENAVIMPYVNVGRGARLKNVVIDRGVEIPEGLVIGEDPELDAKRFRTTEQGISLITQPMIDRLNT

SEQ ID NO: 19152 - protein, 347 aa, Symbiodinium sp. JCUCS-1
MATKIGINGFGRIGRMVFQAICDQNLLGTKLDVVGVVDMSTDAEYFAYQMKYDTVHGRFKHDVKIGEKDELIVNGNKIKCIQASREGPKALPWKEMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSYTATQKTVDGVSAKDWRGGRAASCNIIPSATGAAKAVGEVLPTTKGKLTGMAFRVPTPDVSVVDLTFTAEKDTSIEEIDALFKKASETYMKGVLSFTDEELVSADFIHNVNSSIYDSKATLQNNLKGEKRFFKIVSWYDNEWGYSNRVVDLLMHMISA

SEQ ID NO: 19153 - protein, 296 aa, Xylella fastidiosa Dixon
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKR

SEQ ID NO: 19154 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 19155 - protein, 437 aa, Thermosynechococcus elongatus BP-1
MAVQMEFSMKRVLAIILGGGAGTRLYPLTKRRAKPAVPLAGKYRLIDIPVSNCINSEIHNIYVLTQFNSASLNRHIARTYTFPGLTGGFVEVLAAQQTPENPNWFQGTADAVRQYLWLLADWDVDEYLILSGDHLYRMDYRLFVQRHRDTGADVTLSVLPVEEKAASGFGLLKVDGTGRVTDFREKPTGDALRDMRVDTTRYGLTIEEAHRKPYIASMGIYVFKRQVLIDLLQQMADATDFGKEIIPAAARSHLVQTYLFNGYWEDIGTIGSFYEANLALTQQPQPPFSFYDENAPIYTRPRYLPPSKILSSTITESIISEGCILKECQVHRSVLGVRSRVESGCVIDHSLLMGADYYQDSAQRSQLRLQHKIPIGIGANSVIRRAIVDKNACIGRDVKIINKDNVEESNREDQGFYIRSGVVVIIKNAVIPDGTII

SEQ ID NO: 19156 - protein, 322 aa, Arabidopsis thaliana
MAISSESQVPLSLPIIDFSNPDLKPETPEWDLVRSQVRKALEEYGCFEALFDGASMELRKALFESSKEVFDLPLETKLSTKTDVHYEGYLTIPRVPIQEGMGFYGIDNPNVVNDLTHKLWPQGNIFVGKNVQSFAEKLIELNLTVRTMTLESFGLEKYMEEHLNAANKHFQLLKYKGISDDNTENKIGFYPHIDRHFLTILCQNDAVDGLEIKTKDGEEWIKVKPSQASSFIVMAGASLHVLLNGGVFPPLHRVVITGKKDRYVAALFTIPKEGVIINAPEEMVDDEHPRLYKPFDFWGFLKFSNLPNARKDISDLTDYCAL

SEQ ID NO: 19157 - protein, 490 aa, Chlamydomonas reinhardtii
MAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 19158 - protein, 451 aa, Gigartina divaricata
TDVLALFRVSPQPGVDPVEASAAVAGESSTATWTVVWTDLLTACDLYRAKAYKVDIVPNTTDQYFAYIAYDIDLFEEGSIANLTASIIGNVFGFKALKALRLEDMRLPVAYLKTFQGPATGIICERERMDKFGRPFLGATVKPKLGLSGKNYGRVVYEGLKGGLDFLKDDENINSQPFMRWKERYLYSMEAVNRSIAASWETKGHYLNVTAATMEEMYERAEFAKQLGSIIIMIDLVIGYTAIQTMAVWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESIVIARNEGRDYVTEGPQILQDAAKTCGPLQTALDLWKDITFNYTSTDTADFVETPTANV

SEQ ID NO: 19159 - protein, 147 aa, Triticum aestivum
MPLVSLRAKLNTLLAVMYASGTLDEQFKQLRAMEEDGGAPPGFVAEAVTLFIREADRILTELAALMKQRVVDVDKADALLRQLKGSCISIGAKQLSVSCTYFRQFYKEKPKGCLFVLTLLRNEFYDVRNKFQTMMHLEQQIEACSPK

SEQ ID NO: 19160 - protein, 296 aa, Yersinia enterocolitica (type 0:9)
MKCLKAVIPVAGLGTRMLPATKAIPKEMLPVVDKPLIQYIVNECVAAGVKEIVLVSHSSKNAIENHFDTSFELEAALESRVKRQLLKEIKSICPPDVTIMQVRQGHAKGLGHAVLCAQPMVGDNPFIVLLPDVLLDDSTADLSKENLASMIKRFEETGRSQIMVEPVPQADVSKYGIADCGHVDLAPGESTLMTAVVEKPSVEDAPSNLAVVGRYVLSKDIWPLLKKTPRGAGDEIQLTDAIAMLMEQEPVEAFHMTGKSHDCGDKLGYMKAFVTYGVRHSTEGENFTAWLKQQID

SEQ ID NO: 19161 - protein, 183 aa, Zea mays
ENKLKFSQFLEKEYKVKINPSSMFDVQVKRIHEYKRQLLNCLHVVTMYNRIKKDPKKLFVPRTVIIGGKAAPGYYMAKLIIKLITSVAEVVNNDPVVGSKLKLIFLENYRVSLAEKVIPATDLSEQISTAGTEASGTGNMKFMLNGALTIGTMDGANVEMAEEAGEENLFIFGMRIEDVAALD

SEQ ID NO: 19162 - protein, 90 aa, Porteresia coarctata
RDGKARYVKFHWKPTCGVSCLMDDEATLVGGKNHSHATQDLYDSIAAGNFPEWKLFVQVINPEEEERFDFDPLDDTKTWPEDEVPLRPVG

SEQ ID NO: 19163 - protein, 136 aa, Triticum aestivum
  unsure (1)..(136): unsure at all Xaa locations
GISLQTVLXFGPTISIFGVCMGVQPIGEAFARKIIRVRSGVMHEKSSPVYYLQVLGQSILEGLFIPFTAARYHSLVIEYFPFPRDELGVPAWIEDVLVMAARPKKYTHIQGVQFPPDSIITLEGKKIIVNFARYVP

SEQ ID NO: 19164 - protein, 188 aa, Streptococcus agalactiae NEM316
MLLLVDNYDSFTYNLKQYLSVYKEIFVIKNDDPNLFLLAESAEAIVLSPGPGHPKDAGKILELINQFIGQKPILGICLGHQALAECLGGRLNLANHVMHGKQSWVTINDHTSLFKGIDSPTQVMRYHSLVVTDLPENIAIIARSNEDNEIMAFHCPSLKVYAMQFHPESIGSIDGMKMIENFLTLIND

SEQ ID NO: 19165 - protein, 119 aa, Schedonorus arundinaceus
GGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETQE

SEQ ID NO: 19166 - protein, 533 aa, Pseudomonas aeruginosa PAO1
MKLLAVRRLLRIQRVVIRYRLDDLILELPMLPWWLRLLGATLPWRWLPRRKLELTRGARLRLALQDLGPIFIKFGQILSTRRDLLPDDIANELAWLQDKVPPFPPELAVKRIEEQLGAKIEQVFARFEREPLASASVAQVHAARLKSGEEVVVKVIRPNLEPVIRSDIAWLFILARLAERVSSEARRLHPVEVVSDYEKTIVDELDLLREAANASQLRRNFEGSPLLYVPQVYWDWCRPKVLVMERIYGIPVTDLETLRDQRTDFKALAERGVEIFFTQVFRDSFFHADMHPGNIFVSTRAPWSPQYIAVDCGIVGSLTDEDQDYLARNLIAFFKRDYRKVAQLHIDSGWVPAETKVNDFEAAIRTVCEPIFEKPLKDISFGQVLLRLFQTARRFNMEIQPQLVLLQKTLLNIEGLGRQLYPELDLWATAQPFLERWMRERVSPKQLLRNFQQQVEQVPHLSQMARDTLERLSQPHAHNAPPPEWKGSRHDWLGRLVGAVLLVGAAEVGLGQQLEAWPAWVMLAGGVFLILRR

SEQ ID NO: 19167 - protein, 468 aa, Staphylococcus epidermidis ATCC 12228
MTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 19168 - protein, 408 aa, Prochlorococcus marinus subsp. pastoris str. CCMP1378
MVKVNENYLKLKAGYLFPEISKRVNNYTQANSSSKVIKLGIGDVTEPLPKACVKAMGEALNEMGTNNGFKGYGPEQGYGWLREKISVNDFISRGCQISSEEIFVSDGSKCDSSNILDILGSDNLIAVTDPVYPVYVDTNVMTGRTGETLQNGTYQGLVYLAINEENKFQPEIPKKKVDIVYLCFPNNPTGATITKQELKKWVDYAIENKSLILFDAAYEAFIQDKNIPHSIYEIEGAKNCAIEFRSFSKNAGFTGVRCAYTVIPKNLSGQNSKGDKIDLWSLWNRRQCTKFNGVSYIVQRGAEAVYSSQGKKEVNSLIDFYMKNAEIMQNKLRSAGFKVYGGDNAPYVWIKVPDRMTSWDFFDYLLEKADVVGTPGSGFGLAGEGYFRLSAFNSRMNVNNAMERIINI

SEQ ID NO: 19169 - protein, 130 aa, Dechloromonas sp. RCB
MQLVKAPKQFDVMVTGNMFGDILSDEASMLTGSIGMLPSASLDDKNKGLYEPSHGSAPDIAGKGVANPLATILSAAMMLRYTFGLEEQALRVENAVKKVLAQGYRTGDIYERGTNKVGTREMGDAVLAAL

SEQ ID NO: 19170 - protein, 324 aa, Oryza sativa (japonica cultivar-group); identical to SEQ ID NO: 18117

SEQ ID NO: 19171 - protein, 427 aa, Batrachospermum macrosporum
IEASAAVAGESSTATWTVVWTDLLTACDLYRAKAYKVDAVPNTADQYFAYIAYDIDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWRERFLFSIEGVNRAQAATGEVKGHYLNVTAGTMEDMYERAEFAKELGSVICMIDLVIGYTAIQTMAVWARKADMILHLHRAGNSTYSRQKIHGMNFRVICKWMRMAGVDHIHAGTVVGKLEGDPLMIKGFYNTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADFV

SEQ ID NO: 19172 - protein, 360 aa, Triticum aestivum
  unsure (1)..(360): unsure at all Xaa locations
HGSPSPSAFPQASRAPTLLLVLVGVVAAARIIVRASLPRPPTAPPQERATQRFDSGRREWRRRRPSPPPTSPASPPPPRPRSTTTRTTSSASAAPAAXAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 19173 - protein, 334 aa, Clostridium pasteurianum
MTKVAINGFGRIGRLALRRILEVPGLEVVAINDLTDAKMLAHLFKYDSSQGRFNGEIEVKEGAFVVNGKEVKVFAEADPEKLPWGELGIDVVLECTGFFTKKEKAEAHVRAGAKKVVISAPAGNDLKTIVFNVNNEDLDGTETVISGASCTTNCLAPMAKVLNDKFGIEKGFMTTIHAYTNDQNTLDGPHRKGDFRRARAAAVSIIPNSTGAAKAIAQVIPELKGKLDGNAQRVPVPTGSVTELISVLKKNVTVEEINAAMKEAANESFGYTEDEIVSADVVGISYGSLFDATLTKIVDVDGSQLVKTVSWYDNEMSYTSQLVRTLEYFAKIAK

SEQ ID NO: 19174 - protein, 422 aa, Pseudomonas syringae pv. syringae B728a
MSDLKTAALEYHANPRPGKLSVELTKPTATARDLALAYSPGVAEPVREIARDPELAYKYTGKGNLVAVISDGTAILGLGDLGPLASKPVMEGKGVLFKRFAGIDVFDIEVDSESPQAFIDTVKRISITFGGINLEDIKAPECFEIEKALIEQCDIPVFHDDQHGTAIVTAAGMINALEIVGKTLESAKIVCLGAGAAAISCMKLLVSMGAKIENIFMVDRTGVIHSGRTDLNQYKAAFAHATEKRSLTDALDGADVFVGLSGPNLLSAENLKLMAKDPIVFACSNPDPEISPELAHATRSDVIMATGRSDYPNQVNNVLGFPFIFRGALDVRAKRINEEMKIAAANALRELAKLPVPQEVSDAYGGIKLEFGREYIIPKPMDTRLLGLIADAVAKAAIESGVATLPYPKHYPLTSVDDVFKG

SEQ ID NO: 19175 - protein, 519 aa, Arabidopsis thaliana
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALLLAFNFQLFGNLLPFKYCLGFGFEI

SEQ ID NO: 19176 - protein, 182 aa, Pyrococcus woesei
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKYL

SEQ ID NO: 19177 - protein, 1241 aa, Arabidopsis thaliana
MLVARSGCSRTLIRMGNDENLMVMVDVEEGEIPDSVNTEIEVKHKSTTTTADVGGDVDVGVVAGGRGGGGGGSNGNSRVWTMEELISQYPAYRPYANSGLSNLAWARAVQNKPFNEGLVMDYEPRESDKIVIEDSDDEKEEGELEEGEIDLVDNASDDNLVEKDTESVVLISADKVEDDRILKERDLEKKVKLIRGVLESTSLVEAQTGFEGVCSRILGALESLRELVSDNDDFPKRDTLVQLSFASLQTINYVFCSMNNISKERNKETMSRLLTLVNDHFSQFLSFNQKNEIETMNQDLSRSAIAVFAGTSSEENVNQMTQPSNGDSFLAKKLTSESTHRGAAYLRSRLPMLPLLDLHKDHDADSLPSPTRETTPSLPVNGRHTMVRPGFPVGRESQTTEGAKVYSYESDARKAVSTYQQKFGLNSVFKTDDLPSPTPSGEPNDGNGDVGGEVSSSVVKSSNPGSHLIYGQDVPLPSNFNSRSMPVANSVSSTVPPHHLSIHAISAPTASDQTVKPSAKSRDPRLRLAKPDAANVTIYSYSSGDARNLSKVELSADLVNPRKQKAADEFLIDGPAWKRQKSDTDAPKAAGTGGWLEDTESSGLLKLESKPRLIENGVTSMTSSVMPTSAVSVSQKVRTASTDTASLQSLLKDIAVNPTMLLNLLKMGERQKVPEKAIQKPMDPRRAAQLPGSSVQPGVSTPLSIPASNALAANSLNSGVLQDSSQNAPAAESGSIRMKPRDPRRILHGSTLQRTDSSMEKQTKVNDPSTLGTLTMKGKAEDLETPPQLDPRQNISQNGTSKMKISGELLSGKTPDFSTQFTKNLKSIADMVVVSQQLGNPPASMHSVQLKTERDVKHNPSNPNAQDEDVSVSAASVTAAAGPTRSMNSWGDVEHLFEGYDDIQRVAIQRERVRRLEEQNKMFASQKLSLVLDIDHTLLNSAKFNEVESRHEEILRKKEEQDREKPYRHLFRFLHMGMWTKLRPGIWNFLEKASKLYELHLYTMGNKLYVTEMAKLLDPKGVLFNGRVISKGDDGDPLDGDERVPKSKDLEGVMGMESSVVIIDDSVRVWPQHKMNLIAVERYLYFPCSRRQFGLLGPSLLELDRDEVPEEGTLASSLAVIEKIHQNFFSHTSLDEVDVRNILASEQRKILAGCRIVFSRIIPVGEAKPHLHPLWQTAEQFGAVCTTQVDEHVTHVVTNSLGTDKVNWALTRGRFVVHPGWVEASAFLYQRANENLYAINP

SEQ ID NO: 19178 - protein, 116 aa, Triticum aestivum
GRSSPPGPAFDGAIDFMHRYEEVDYYPSRHAPLRHAEPASFPVPTRPVVGKREKTRIKKENDFVQPGERYRSWAPAPHHCSSPPFSSPHFPPEFSPSIPRSPDARPPPSAPCPLMS

SEQ ID NO: 19179 - protein, 404 aa, Zea mays
  unsure (1)..(404): unsure at all Xaa locations
MDGGGQPPDTEMSEAGAGGGGQPPQQPLPPVGGGVMLDNIQATLSHGGRFIQYNIFGNVFEVTAKYKPPVLPIGKGAYGIVCSALNSETAEQVAIKKIANAFDNKIDAKRTLREIKLLRHMDHENIVAIRDIIPPAQRAAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPCHARQSFPEKFPHVQPLAIDLVEKMLTFDPRQRITVEGALAHPYLASLHDISDEPVCSMPFSFDFEQHALSEEQMKDLIYQEALXFNPDYQPFGSNR

SEQ ID NO: 19180 - protein, 389 aa, Chlamydomonas reinhardtii
MAAMMMRQKVAGAIAGERRSAVAPKMGRAATAPVVVASANASAFKGAAVTARVKASTRAARVQSRRTAVLTQAKIGDSLAEFLVEATPDPKLRHVMMSMAEATRTIAHKVRTASCAGTACVNSFGDEQLAVDMVADKLLFEALKYSHVCKLACSEEVPEPVDMGGEGFCVAFDPLDGSSSSDTNFAVGTIFGVWPGDKLTNITGREQVAAGMGIYGPRTVFCIALKDAPGCHEFLLMDDGKWMHVKETTHIGEGKMFAPGNLRATFDNPAYERLINFYLGEKYTLRYTGGIVPDLFQIIVKEKGVFTNLTSPTTKAKLRILFEVAPLALLIEKAGGASSCDGKAVSALDIPILVCDQRTQICYGSIGEVRRFEEYMYGTSPRFSEKVVA

SEQ ID NO: 19181 - protein, 416 aa, Salmonella typhimurium LT2
MESKVVVPVEGKKITLQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIANM

SEQ ID NO: 19182 - protein, 157 aa, Triticum aestivum
PLVRLPQVIISRPRPRGFGLSTTADDAKNYLRVIILLQYVPRIIRFVPLLGGRQSATGFIFESAWANFVINLLMFVLAGHVVGSCWYLFGLQRVNQCLQNACAASNISSCKVFRDCGLNFDIGGQNEQISQQWFNEPASTACFDTGNDTNFQYGIYQ

SEQ ID NO: 19183 - protein, 304 aa, Oryza sativa
LPMQFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGR

SEQ ID NO: 19184 - protein, 282 aa, Rhizobium sp. NGR234
MKVWFITGASRGFGALMTKEALAAGDAVVATARNSSTVVEQFGDNPNLLAVALDVTNEAQAKDAAAKAIERFGRIDILVNNAGYGLLGAVEEATAEEVEKLYATNVFGLLKVTRAVLPYMRRQRAGHVLNFSSVGGYFGYPGWGVYGSTKFAVEGLSESLAAELKPFGIKVTIVEPGFFRTDFLADNSLSVSAAAIPDYVGTPAGDMRTFAAQANRSQPGNPVKLAAGIATLVNAANPPLRMPFGSDTVAVIEEQNAGVARELAEWRELALSTDFPKDEIAA

SEQ ID NO: 19185 - protein, 509 aa, Xylella fastidiosa 9a5c
MKQISILVRLFITPYVSYPCGFLHSSRPVMSFLPSFLKRKSIDLITVHEEGRRLVPTLSWPHLIALGIGAIVGTGIYTLIGVGAEKAGPAILLSFVIAGVICACAALAYAEMATMMPVAGSTYTYSYVALGEGIAWIVGWSLILEYSLVVSTVAVGWSGYMSGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 19186 - protein, 332 aa, Wigglesworthia glossinidia endosymbiont of Glossina brevipalpis
MTLNIALNGFGRIGRMIFRIAQTRNNFNIVAINDLCSINEISYMLRFDSTHGKFLKKIYIKENFIQIEDKKIYCFSEKDPSNLPWKKLNIDIVIEATGLSLTKKASENHIISGAKKVIITAPPKDNIPMFVMGVNNNLYNGEKIISNASCTTNCLAPIAKVLNDYFGIQEALMTTVHSVTSTQNTVDGRSLQAFRIGRSCLNNIIPTSTGAADSVGKIIPDLNGKITGTSFRVPTTNVSVVDLTVKFKKETSYKEVCNAIKYESKNKFNGILGYTEDNVVSSDFNGEFLTSVFDSKAGIELNKTFMKIISWYDNESGYSSKVLDLAQYIFNK

SEQ ID NO: 19187 - protein, 358 aa, Glycine max
MGSLEAERTTVGLAARDPSGILSPYTYNLRNTGPDDVYIKVHYCGICHSDLHQIKNDLGMSNYPMVPGHEVVGEVLEVGSNVSRFRVGELVGVGLLVGCCKNCQPCQQDIENYCSKKIWSYNDVYVDGKPTQGGFAETMIVEQKFVVKIPEGLAPEQVAPLLCAGVTVYSPLVHFGLKESGLRGGILGLGGVGHMGVKIAKALGHHVTVISSSDKKKQEALEHLGADQYLVSSDATAMQEAADSLDYIIDTVPVGHPLEPYLSLLKLDGKLILMGVINTPLQFVSPMVMLGRKSITGSFIGSMKETEEMLEFWKEKGLSSMIEMVNMDYINKAFERLEKNDVRYRFVVDVKGSKLVDQ

SEQ ID NO: 19188 - protein, 376 aa, Xylella fastidiosa Dixon
MLKKHLFIVKPIEPTNHTGTGKGETQLKRSLTARQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFATRYVNTDNWVPFVPDNVAPGKYGIEGVIRGAAVVFFSYIGFDAVSTTAGEAKNPQRDMPIGILGSLAICTVIYIVFSGVLTGLMHYSQLDTPKPVATALETYPTLSWLKHVVEIGAIAGLSSTMLMMLMAQPRIFYAMSQDGLLPKLLSKVHPKFQTPHVGTL

SEQ ID NO: 19189 - protein, 280 aa, Schedonorus pratensis
MAARLSFLVVLALLAVLTAKADFDDQFEVIGDRDHIGYKDDGNGGQEFSLELDQESGSGFKSKNKYLFGEFSVRMKLVDGNSAGTVTSFYLTSGESSTHDEIDIEFMGNSSGQPYVMNTNVWASGDGKKEHQFYLWFDPSADFHTYKITWNPKNIIFEVDNVAVRTFKNYDDLPFPTSRPMEVHATLWDGSYWATQHGNVKIHWRHEPFVVSYRAYHANGCVHSKNSSRCPDGSDAWMHRELGDEELDTVAWTERNCLSYNYCADGWRFPKGFPGECGRK

SEQ ID NO: 19190 - protein, 197 aa, Zea mays
  unsure (1)..(197): unsure at all Xaa locations
MAATIQSVNARQIFDRRLYLTVQVIVFCSDGTFGWAAAPIGASIVVYQALEFRDGRSDYXRRVSTQMRNNVNSVIGPTLIGKDPTVQTEIDNFMDQHHYGTKNEWGXSKLKLGANAILTESLXTCKAGPNIKXIPLYHIIANLPXNKQLEMPVPALNVINGGYHAGNKIAMXEFMILATGAAXIXEAMNIGVETYHH

SEQ ID NO: 19191 - protein, 189 aa, Glycine max
  unsure (1)..(189): unsure at all Xaa locations
KNPSFESFPLSPLFPLSDSIPKQIPLSEDFASIFINLDCKLDLKTIVLQARNAEYNPKRFAAVIMRIRDPKTTALIFASGKMVCTGAKSEQQSKLAARKDFKIQIIVGSCDVKFPIXLEGLAYSHGAFSSYDTELFPGLIYRMKQPKMVXLLIFVSGKIVLTGAKVIFLLIIPPPLVHWIFFSVFISIF

SEQ ID NO: 19192 - protein, 355 aa, Bradyrhizobium japonicum USDA 110
MKSFKVADFKAPLQEFDEPTPQPSGTQVLIKVKAAGVCHSDLHIWEGGYDLGHGRKPLSLKDRGINLPLTMGHETVGEIVAFGPDVKPTDQGDLRLGDVGLVYPWIGCGKCATCLGGDENMCLTPRSLGVYCDGGYSDHMLVPHPRYLLNLKGLDPATTAPYACSGVTTYSALKKVEQHFDTPIVMFGAGGLGLMALSLLKAMGGKGAIMVDIDARKREAAEKAGALATVDPKAPDALEQLAKKAGGPIRAVIDLVGNAATTQLGFDCLTKGGKLVIVGLFGGGATWALPLIPIKAVTIQGSYVGNLRETQELLDLVRTKNVPPIPVTRQPLAKANDALVQLQQGAVVGRTVLTP

SEQ ID NO: 19193 - protein, 101 aa, Synechococcus sp. PCC 7942
MKELADAFKKAQQVQEGAKQVQEDLNNMEIEGQAQGGLVKVWVSGNQEPLRAEIAPEALNEGAEVLSELVAAAMKDAYQKSTAAMKEKMEALTAGLGIPGL

SEQ ID NO: 19194 - protein, 395 aa, Corynebacterium efficiens YS-314
MNPMTPSTPGNPLQLNREEIFAAHEGGKLSITSARPLADMHDLSLAYTPGVATVCEAIAADPAVARTHTGRGRTVAIISDGTAVLGLGDIGPEAALPVMEGKAQLFSSFAGLNAIPIVLDVHGVDELVDTIAAMAPSFGAINLEDISAPRCFEVERQLIERLDIPVMHDDQHGTAVVILAALRNALRLLDRQIGEARIVVSGAGAAGVAAVEMLRGAGARDVVVLDSRGIIHAGREDLNPVKQALAATTNPRGVTGGMAEALTGADVYIGVSGGHVAEEALQLMADQPILFSLANPSPEIDPELAGRYGAIVATGRSDLPNQINNVLAFPGIFHGALAARARSITPGMKLAASQAIADIAAETLDVGHVVPSPLDPRVAPAVSAAVQAAAEAEGA

SEQ ID NO: 19195 - protein, 429 aa, Acidithiobacillus thiooxidans
MTTHIQKPATGSPLTLLNGVLQVPDQPIIPFIEGDGIGCDVTPAMRSVVDAAVAKVYGGQRQIAWMELFAGQKAVQLYGEGQYLPDETMAAIREYKVAIKGPLETPVGGGIRSLNVAMRQDLDLYVCLRPVRYFEGTPSPMRHPEKVDMVIFRENSEDIYAGIEWPAGSPEAEKIIRFLREEMGVTKIRFPDSSAIGIKPVSTEGSERLIRRTIQYALEHGKPSVSLVHKGNIMKFTEGGFRDWGYALAEREFAGRVFTWRQKAAISKAEGKAAGQKAEQQAIADGKLIIKDVIADNFLQQILLRPEDYSVVATLNLNGDYVSDALAAEVGGIGMAPGANLSDTHAIFEATHGTAPDIAGQGKANPSSLILSAVMMLEHLGWGEAAQAIVAAMNATIAAGEVTGDLAALRGDVPALSTTEFTAALIRRF

SEQ ID NO: 19196 - protein, 215 aa, Glycine max; identical to SEQ ID NO: 6605
  unsure (1)..(215): unsure at all Xaa locations

SEQ ID NO: 19197 - protein, 794 aa, GIBBERELLA ZEAE PH-1
MTDRYVAVHEAANGPGDARPTADQIIKDENLEGKLKDHVIFLTGCSAGIGVDTAKALYLTGATLYLTARNLDKAKTALGDLVQDDRVHLLELDLESLDSVRSCAAKFLSESLKLNILICNAGVMCTPEGRTKEGFETQFATNHLAHFLLFNLLRPSLQKGVKPDRAARVVMLSSLGHRFGEPDFNNINMEGCYDPHKAYVKSKTANLWTANEIERRYGSEGIHAWSVHPGAVLTDLGRHLSEEQKNSLGGDPYLNSVWKFSSQGAATTVWAATAEALEGQGGRYLEDCQIIGKWDPSTSRYAPGYGDHAYDEGKAKAFHIFNSCISNATSPFIDFVFPSLAVTLVVYRVAKGVPIKNSKPCKLQASILVGVQKDTLLAKDIDCFTCPFLATSKRLPGVNPLDSIELFLRRRIGLADSPKAMRIVSCNHSYLCHFLEGCRQPWIGFLSPNFKNTAHFRQKVEAVASAQLTSVTFNYPIHIFHRFRLIFTKTLHKPTSTALPLNMESITTEPPQYDVLFKDQDFPGSLPTPNDTESGEPLPIDRTFCDKLVRIRNDFIMKYGPEVKPIEAHNMLYVAKNTSLVVPKVYAIYQGKETPQNFTYILMQHIQGKTLKELWPELDGTRKTSIAKTLRDSLQQLRRLQHPGYFGNIDGGPPLDDVFTGTQGGLKNVTSPFATEEELINSVIRIFSLETRSWSVNLVKYYQYVLPTVLHSNKAPVFTHNDLQRKNIMVQDDGTIVIIDWEYSSWYPVYWEYSTAMFANGGWRDDWGEYLRIILDEYLNEAVWICQMKTQMWS

SEQ ID NO: 19198 - protein, 714 aa, Paenibacillus macerans
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTLTLITSRSDRLRPQPHVSGRAGTNPGFAENGALYDNGSLLGAYSNDTAGLFHHNGGTDFSTIEDGIYKNLYDLADINHNNNAMDAYFKSAIDLWLGMGVDGIRFDAVKQYPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGTWDPNKAIGPMYNQVIAKYPSWYYDVSVPAGTKLDFKFIKKGGGTVTWEGGGNHTYTTPASGVGTVTVDWQN

SEQ ID NO: 19199 - protein, 180 aa, Triticum aestivum
FGRARRALPLAPSPGLGRGEAAAVPVADGDVHRWEEGIARGRDLADVLKLLPVNSLSCKQIERRSCISLEAFIRDYFLCESPVILSGCIEHWPARTKWKDIKYLQSIAGDRTIPVQVGKNYACTELKQELITFSQFLERMWSSDSANLACLAQHPLFDQIKELHEDISVPEYWLAGGGKL

SEQ ID NO: 19200 - protein, 356 aa, Streptomyces peucetius
MTAEPTVAARPQQIDALRTLIRLGSLHTPMVVRTAATLRLVDHILAGARTVKALAARTDTRPEALLRLIRHLVAIGLLEEDAPGEFVPTEVGELLADDHPAAQRAWHDLTQAVARADISFTRLPDAIRTGRPTYESIYGKPFYEDLAGRPDLRASFDSLLACDQDVAFDAPAAAYDWTNVRHVLDVGGGKGGFAAAIARRAPHVSATVLEMAGTVDTARSYLKDEGLSDRVDVVEGDFFEPLPRKADAIILSFVLLNWPDHDAVRILTRCAEALEPGGRILIHERDDLHENSFNEQFTELDLRMLVFLGGALRTREKWDGLAASAGLVVEEVRQLPSPTIPYDLSLLVLAPAATGA

SEQ ID NO: 19201 - protein, 301 aa, Triticum aestivum
MTVVRGWGTHLSCGSAGFTAAGWEGPRQKGGRAWFAPRNILGMIAGGGQLWHGRARIHCGTPNAVNMTASLAVLNTNDSAATSLLTWTCLDVVLFGSPSHLISGQSMKRGWDGLTAGAGRAQEGAPAGRAVYAGGVPWFTLMILHTTSALLMKGDDTPAVFHPHAAAGVHGGACTGLHATPELMTMESSVPGPKGAFYGGGIKQVGKQLAGAAFVIVWNLVVTTLILLGIGLFVPLRMPDDQLMIGDDSAHGEEAYALWGDGEKLDATRHDVSRGAGGEREMGTAEQRLAGMGARGVTIQL

SEQ ID NO: 19202 - protein, 507 aa, Eremothecium gossypii
MSKNAEGNNKENGSESDLSVTIKLPNGVEYEQPTGLFINNEFVRSKLGGMMEVIAPATEEVVTRVYEGTSEDVDIAVSAAQKAFKSGKWFGADPMVRVKALSKLADLIEEDLEVIASIEFLDNGKVFSHARFDIGMVVNYLRCCAGLADKVDGRSIDTGSSHLTYTRREPIGVCGQIIPWNFPLLMWAWKVGPALATGNTVVLKTAEFTPLSALYVSNHVRKAGIPAGVVNIISGYGKTVGEAIIRHPGVKKIAFTGSTATGRHIYEVAAKDLKKVSLELGGKSPNIIFADADLKKAAQNVLNSIFFNGGEVCCAGSRMYIEEPIYEEFLQEIKAVAESVKVGDPSWKDTFQGAQTSQMQLDKILSYIEIGKQEGARVVTGGERLGEKGYYVKPTIFADVREDMRIVKEEIFGPVVTVTKFTNIDDLLEMANDTQYGLAAGVYSSSMKKAIDVANRLDAGTVWINTYNDFHCSVPFGGYKGSGFGREMGAEVVENYTQVKAVRALLL

SEQ ID NO: 19203 - protein, 130 aa, Pimpinella brachycarpa
GTRESKVFYLKMKGDYHRYMAEFKVGDERKNAAEDTMNSYKAAQDIALADLAPTHPIRLGLALNFSVFYYEILNSSDKACSMAKQAFEEAIAELDTLGEESYKDSTLIMQLLRDNLTLWTSDSQDQLDEP

SEQ ID NO: 19204 - protein, 95 aa, Glycine max
FSAFALNSAKAKPQELAVTVASDAFTQFKHLLLPITDRNPYLSESTRQAIATTSALAKKYGADITVVVIDEQQKESLPEHETQLPSIRWHLSEGL

SEQ ID NO: 19205 - protein, 592 aa, Oryza sativa
MAASSAQLIFLLLLAVLAAASSRNDEEARALMALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANVLDWPTRVSIIRGIAKGVEYMHSKKANKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLAAIAALCTSETASQRPTMEAVVQQLSNCH

SEQ ID NO: 19206 - protein, 423 aa, Mesorhizobium sp. HN8A1
VMFDGSSIAGWKAINESDMVLMPDPDTVHMDPFFAHSTMVILCDILDPVSGESYNRDPRGTAKKAEAYMKSEGIGDQIFVGPEAEFFVFDDVKYKADPYNTGFKLDSTELPSNDDTDYDTGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSG

SEQ ID NO: 19207 - protein, 470 aa, Gelidium latifolium
  unsure (1)..(470): unsure at all Xaa locations
GVIPYAKMGYWDPDYAVKETDVLALFRVTPQPGVDPVEASRAVAGESSTATWTVVWTDLLTACDLYRAKAYKVEEVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIXXXEGRSFVEEGPQILRDAAKTCGPLQTALDLWKDISFNYTSTDTADFVETPTANV

SEQ ID NO: 19208 - protein, 522 aa, Oryza sativa
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 19209 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILVQCLEREGVDNVFAYPGGASMEIHQALTRSDRITNVLCRHEQGEIFAAEGYAKASGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWDSPMSITGYISRLPPPVEESQMIPVLRAIQSASKPVIYYGGGCLDARDELREFAARTGIPLASTFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGAIRTMLDTPGPYLLEVMVPHIEHVLPMIPGGATFKDIITEGDGSVKY

SEQ ID NO: 19210 - protein, 217 aa, Brucella suis 1330
MKFFVDTADVKEIRELNDLGLVDGVTTNPSLILKSGRDIIEVTKEICNIVKGPVSAEVAATEYEQMMKEAAVIARIADNICIKLPVTLDGLKACKALTSEGHKVNMTLCFSANQALLAAKAGATFISPFIGRLDDTGINGMELIAEIRTIYDNYDFRTEILAASVRTVNHVKEAALIGADVVTAPPATLKALVKHPLTDKGLETFLADWAKTGQKIA

SEQ ID NO: 19211 - protein, 171 aa, Triticum aestivum
  unsure (1)..(171): unsure at all Xaa locations
MAPAVMASSATTVAPFQGLKSTAGLPVSRRSSGSLGSVSNGGRIRCMQVWPIEGIKKFEXTLSYLPPLSTEALLKQVDYLIRSXKWVPCLEFSKVGFVFREQNSSXPGYYDGRYWXQCWKLPMFGXCTDATQVLKQGGGVKKEYLTLCRVSVHNCASACVTPLSTGKIREG

SEQ ID NO: 19212 - protein, 463 aa, Pseudomonas putida KT2440
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 19213 - protein, 504 aa, Triticum aestivum
  unsure (1)..(504): unsure at all Xaa locations
MAGGVFLLNGADAPDYGGALTVPVVVTCLMAASGGLIFGYDIGISGGVSEMESFLKKFFPGLLKTTRHASKDVYCMYNDQALTAFTSSLYAFGMVGTLVASRVTRRVGRKAIMVIGGSMFLVGLLVNAGGGNLAMLIVGRMMLGLGLGFSGQATPVYLAEMSPPRWRGGFISAFPLFISVGYLVANLINYGTSRIPEWGWRLSLGLAAVPAAVMVLGAVLITDTPSSLVLRGKHDHARAALQRVRGKGVDVDAEFSDILAAVEHDRRNQEGAFRRILRREYRPYLVMAVAFPVFLNLTGVTVSAFFSPILFRTIGFGSDAALMGAIILGLMNIGGIIASGVAMDRYGRKLLFAICGALMFTCQVAMASIAGTHLGHGSKMPKGYAVAVLVLTCVFSASFSWSWGALYWTIPGEIYPVEVRSAGQGTAVALNLGLNFVQAQCFLAMLCSLKYGVFLFYAFWLVVMTAFAMALVPETKGVPLDSMGPLFXARHWXYWGRFVKDTIE

SEQ ID NO: 19214 - protein, 85 aa, Glycine max
MAKHHPDLIMCRKQPGIAIGRLCEKCDGKCVICDSYVRPCTLVRVCDECNYGSFQGRCVICGGVGISDAYYCKECTQQEKDRDGC

SEQ ID NO: 19215 - protein, 523 aa, Aspergillus saitoi
MRITSAIASLLLVGTATSLQNPHRRAVPPPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 19216 - protein, 450 aa, Eremothecium gossypii
MSKRIIQLILLSAFARANYVEPFKSNPYIACSEASHCPKEWPCCSQYGQCGSGPLCISGCNPKFSHSPESCVPVPALLPQLEIVASDDKGVYLEMSGQPALVTKFQRKSSAQLLEVHHEEQQYGVSALEQDLNSRGLIHFPDYMITSKPKVAREMLEQYDFIHSGFISVDGKSESLILGMPKKTTGSLISSSKVFLYGRAAVTMKTSRGPGVITAIVFMSSTQDEIDYEFVGSELHTVQTNYYYQGELNHSRMRRHSLPSNSHEEYHIYEVDWDAERIHWMVDGEIVRTLYKRDTWDPVHKIYKYPQTPMMLQISLWPAGTPDAPQGTIEWAGGLIDWENAPDIKAHGQLAAQIQRVAITPYNNDFCPEIHESMGQWGAQNSEEEPFRVAYGYESNNGRFDPKKLKWYTDARLHLSSWHATGIKPTAAQRQQHHRRSLPHVEAPPITNTM

SEQ ID NO: 19217 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 19218 - protein, 297 aa, Brucella melitensis 16M
MSSIRKIRKAVFPVAGLGTRFLPATKSIPKEMLTVVDKPVIQYVVDEAREAGIEHLIFVTGRNKAVIEDYFDAQVELYSTLAERGKTEELNRLQDLQPQPGTTSFTRQQVPLGLGHAVWCARELVGNEPFALLLPDMVMQSKKGCLAEMVELYEQTGGNIIAVQECDPEEAHKYGIVGKGGAVGNGFEITRMVEKPAKGTAPSNLYINGRYILQPEIFGLLSKQEKGAGNEIQLTDAMLKLADQQKFYGFDYRGLTFDCGSKAGFIEANVAFALWREDIRPSVEGSIGHLLKTIQPA

SEQ ID NO: 19219 - protein, 305 aa, Aneurinibacillus thermoaerophilus
MKGIILAGGSGTRLYPLTRAISKQLLPVYDKPMIYYPLSVLMLAGIRDILVISTPEDTPRFEQLLGDGSELGISLSYAIQPSPDGLAEAFIIGEDFIGQDNVALILGDNIFYGQGFTPLLQRAVNRKKGATIFANVVKDPERFGVVEFDENNKVLSIEEKPVYPKSNFAVTGLYFYDNDVVKIAKQIEPSARGELEITDVNKIYLERGDLNVELLGRGFAWLDTGTHESLLEASQFIQTIEKRQGLKVACLEEIAYYKGYINKEQLIRLAEPLKKNEYGAYLLELAEKGSLQTGSINTKEAVLYG

SEQ ID NO: 19220 - protein, 469 aa, Streptomyces viridochromogenes
MFQNADEAKKLIADEDVKFIDVRFCDLPGVMQHFTIPASAFDPAEELAFDGSSIRGFQAIHESDMAVRADLSTARVDPFRRDKTVNINFFIHDPITGEQYSRDPRNVAKKAEAYLASTGIGDTGYFGPEAEFYVFDSVRLANSATESFYHIDSEAGAWNTGALENNRGYKVRYKGGYFPVPPVDHFADLRAQISLELDRAGLQVERHDHEVGTAGQAEINYKFNTLLAAADDLQLFKYIVKNVAWQNGKTATFMPKPIFGDNGSGMHVHQSLWTGGQALFYDEAGYAGLSDTARYYMGGILKHAPSLLAFTNPTVNSYHRLVPGFEAPVNLVYSQRNRSAAMRIPITGSNPKAKRVEFRAPDSSGNPYLAFSALLLAGLDGIKNKIEPAEPIDKDLYELAPEEHAGVPQVPTSLPAVLDRLEADHEFLLAGDVFTPDLIETWIDYKRTNEIAPLQLRPHPYEYEQYYDV

SEQ ID NO: 19221 - protein, 392 aa, Archaeoglobus fulgidus DSM 4304
MKVWLVGAYGIVSTTAMVGARAIERGIAPKIGLVSELPHFEGIEKYAPFSFEFGGHEIRLLSNAYEAAKEHWELNRHFDREILEAVKSDLEGIVARKGTALNCGSGIKELGDIKTLEGEGLSLAEMVSRIEEDIKSFADDETVVINVASTEPLPNYSEEYHGSLEGFERMIDEDRKEYASASMLYAYAALKLGLPYANFTPSPGSAIPALKELAEKKGVPHAGNDGKTGETLVKTTLAPMFAYRNMEVVGWMSYNILGDYDGKVLSARDNKESKVLSKDKVLEKMLGYSPYSITEIQYFPSLVDNKTAFDFVHFKGFLGKLMKFYFIWDAIDAIVAAPLILDIARFLLFAKKKGVKGVVKEMAFFFKSPMDTNVINTHEQFVVLKEWYSNLK

SEQ ID NO: 19222 - protein, 470 aa, Martensia pavonia
  unsure (1)..(470): unsure at all Xaa locations
GVIPYAKMGYWDPNYVTKETDILALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYXXXXXXXXXXXXXXXXXXXXXGTVIIMIDLVIGYTAIQTMAIWARKNDMILHLHRAGNSTYSRQKVHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALEAMVIARNEGRDYVSEGPQILRDAAKTCGPLQTALNLWKDITFNYTSTDTADFVETPTANV

SEQ ID NO: 19223 - protein, 371 aa, Triticum aestivum
  unsure (1)..(371): unsure at all Xaa locations
MARRSAPLLRRLVSSAPPLPGHGGGARRTVTYMPRPGDGTPRPVTLIPGDGIGPLVTGAVEQVMEAMHAPVYFESYDVHGDMPAVPPAVIESIRRNKVCLKGGLATPVGGGVSSLNMQLRKELDLFASLVNCANVPGLLQRHQNVDIVVIRENTEGEYSGLEHEVDPEVVVFQRXLAGYLKFKRHVLXFILAYLYYRKKLTAVHKANIMKLADGLFLESCREIAAKYPSIEYNEIIVDNCCMQLVSRPEQFDVMVTPNLYGNLVANTAAGLVGGTGVMPGGNVGQDHAIFEQGASAGNVGNDNLVEQQKANPVALLLSSAMMLRHLQFPSFADRLETAVKRVIAEGKYRTKDLGGTSTTQEVTDAVIANLD

SEQ ID NO: 19224 - protein, 356 aa, Bacillus subtilis subsp. subtilis str. 168
MNKLIEREKTVYYKEKPDPSSLGFGQYFTDYMFVMDYEEGIGWHHPRIAPYAPLTLDPSSSVFHYGQAVFEGLKAYRTDDGRVLLFRPDQNIKRLNRSCERMSMPPLDEELVLEALTQLVELEKDWVPKEKGTSLYIRPFVIATEPSLGVKASRSYTFMIVLSPVGSYYGDDQLKPVRIYVEDEYVRAVNGGVGFAKTAGNYAASLQAQRKANELGYDQVLWLDAIEKKYVEEVGSMNIFFVINGEAVTPALSGSILSGVTRASAIELIRSWGIPVREERISIDEVYAASARGELTEVFGTGTAAVVTPVGELNIHGKTVIVGDGQIGDLSKKLYETITDIQLGKVKGPFNWTVEV

SEQ ID NO: 19225 - protein, 141 aa, Oenococcus oeni MCW
MADKDLSHLSKEQYEVTQKGATERAFTGKYDDFYEEGIYVDVVDGTPLFSSKDKYDAGCGWPSFTKPIENPSIVKKIDQSLGMTRTEVRSKDSGSHLGHVFDDGPDDKGGLRYCINSAALKFIPVKELKKAGYGEYLSLFK

SEQ ID NO: 19226 - protein, 425 aa, Microbulbifer degradans 2-40
  unsure (1)..(425): unsure at all Xaa locations
MVLFTQWKAVGLGVETLYLACXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAFAVVMCGVIYPVEXGWTWGGNSVFGMYTLGDLGWSDFAGSGIVHMAGAAAALAGVLVLGARKGKYGPNGQINAIPGANLPLATLGTFILWMGWFGFNGGSVLATASVESANSVAIVFMNTNAAAAGGLVSALILARILFGKADLTMALNGALAGLVAITAEPSTPSALQATLFGGLGGLLVVFSILTLDKLKIDDPVGAISVHGVVGLLGLLLVPVTNDASSFSGQIIGALTIFTWVFGTSLAVWFLIKLVIGVRVSEEEEFEGVDLSECGMEAYPEFTNGK

SEQ ID NO: 19227 - protein, 260 aa, Photobacterium leiognathi
MAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDQVVSQDFIGETQTSVFDAKAGTL

SEQ ID NO: 19228 - protein, 140 aa, Glycine max
  unsure (1)..(140): unsure at all Xaa locations
LSTATRAGMVAPFTGLKTMAGFPTSKTNNDITPRASNGGRVSFFXERTPDGKNEVDTLRHLPDDDDAQLAKEPATVLXKGWIPWLEFEKEDGFVYREHKRAPGYYXGRYWTMSDTETFGRTDRSPVLKRLSXGNTGYPQA

SEQ ID NO: 19229 - protein, 100 aa, Glycine max
  unsure (1)..(100): unsure at all Xaa locations
MASSTISDPAVTXVNHAQADIVTTFTDLKSKTALPTRNTNNDITSIGSNTGRVHFMQAYPAHNKNNTDTVSYLAHLYDAQXSKDEEYLIMNGWMNCLQFK

SEQ ID NO: 19230 - protein, 477 aa, Zea mays
  unsure (1)..(477): unsure at all Xaa locations
MATTAVSVDEKLDKLRAEVAXLDQISENEKSGFISLVSRYLSGEAEQIEWSKIQTPTDEVVVPYDTVASPPEDLEETKKLLDKLVVLKLNGGLGTTMGCTGPKSVIEVXRNGFTFLDLIVIQIESLNKKYGCNVPLLLMNSFNTHDDTQKIVEKYSNSNIEIHTFNQSQYPRIVTEDFLPXSPAKGKSGKDGWYPPGHGDVFPSLNNSGKLDILLGSXGKEYVFVANSDNLGAIVDIKILNHLINNQNEYCMXEVTPKTLADVKGGTLISYEGRVQLLEIAQVPDEHVNEFKSIEKFKIFNTNNLWVNLKAIKRLVEXAEALKMEIIPNPKEVDGVKVLQLETAAGAAIRFFDKAIGINVPRSRXFLPVKATSDLLLVQSDLYTLVDGFVIRNPSRANPANPSIELGPEFKKVANFLARFKSIPSIVELDXLKVSGDVWFGSGITXLKGKVTIIAKPGVKLEIPDGDVLENKDVNGP

SEQ ID NO: 19231 - protein, 353 aa, Oculimacula yallundae
MGCGMSSEEKEGKQRNEEIENQLKRDKMLQRNEIKMLLLGAGESGKSTILKQMKLIHEGGYSRDERESFKEIIFSNTVQSMRVILEAMEQLELPLDDQRTEYHVQTIFMQPAQIEGDNLPPEVGNAISALWRDIGVQECFKRSREYQLNDSAEYYFNNIDRISLPDYMPDDQDVLRSRVKTTGITETAFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYSLACDYILNRFVSLNQHETKQIYTHFTCATDTTQIRFVMAAVNDIIIQENLRLCGLI

SEQ ID NO: 19232 - protein, 446 aa, Salmonella typhimurium LT2
MQQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDELPQETRFLQLFNRRHFPFVLFVAAIWTCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 19233 - protein, 221 aa, Microcystis wesenbergii
HKTQREALEFLQDFKSHLEETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 19234 - protein, 235 aa, Stellaria longipes
LIKEIKAAVTIPVMAKARIGHFVEAQILESIGVDYVDESEVLTPADEDHHINKHNFQIPFVCGLSIPRGAPPPAYRRGYAGHDTGPRVRKPSTGNVVEAVRHIRSVMGEIRLLRNMDDDEVFAYAKKISAAYDLVMQTKQLGRLPVVNFAAGGVATPADAALMMQLGCDGVFVGSGVFKSGDPAKRARAIVQAVTHYSDPDLLGRGEFGLGEAMVGIIVRMRRLRGTPIVLNEVI

SEQ ID NO: 19235 - protein, 331 aa, Streptomyces coelicolor A3(2)
MTTNPDGGRHARNDSALLTTPFDSHARAQEVIDGVDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 19236 - protein, 955 aa, Ipomoea batatas
MSRLSGITPRARDDRSQFQNPRLEIAVPDRTAGLQRTKRTLLVKCVLDETKQTIQHVVTEKNEGTLLDAASIASSIKYHAEFSPAFSPERFELPKAYFATAQSVRDALIVNWNATYDYYEKLNMKQAYYLSMEFLQGRALLNAIGNLELTGEYAEALNKLGHNLENVASKEPDAALGNGGLGRLASCFLDSLATLNYPAWGYGLRYKYGLFKQRITKDGQEEVAEDWLELGNPWEIIRMDVSYPVKFFGKVITGSDGKKHWIGGEDILAVAYDVPIPGYKTRTTISLRLWSTKVPSEDFDLYSFNAGEHTKACEAQANAEKICYILYPGDESIEGKILRLKQQYTLCSASLQDIIARFERRSGEYVKWEEFPEKVAVQMNDTHPTLCIPELIRILIDLKGLSWKEAWNITQRTVAYTNHTVLPEALEKWSYELMEKLLPRHIEIIEMIDEQLINEIVSEYGTSDLDMLEKKLNDMRILENFDIPSSIANLFTKPKETSIVDPSEEVEVSGKVVTESVEVSDKVVTESEKDELEEKDTELEKDEDPVPAPIPPKMVRMANLCVVGGHAVNGVAEIHSDIVKEDVFNDFYQLWPEKFQNKTNGVTPRRWIRFCNPALSNIITKWIGTEDWVLNTEKLAELRKFADNEDLQIEWRAAKRSNKVKVASFLKERTGYSVSPNAMFDIQVKRIHEYKRQLLNILGIVYRYKQMKEMSAREREAKFVPRVCIFGGKAFATYVQAKRIAKFITDVGATINHDPEIGDLLKVIFVPDYNVSAAELLIPASGLSQHISTAGMEASGQSNMKFAMNGCILIGTLDGANVEIRQEVGEENFFLFGAEAHEIAGLRKERAEGKFVPDERFEEVKEFIKRGVFGSNTYDELLGSLEGNEGFGRGDYFLVGKDFPSYIECQEKVDEAYRDQKIWTRMSILNTAGSYKFSSDRTIHEYAKDIWNIQPVVFP

SEQ ID NO: 19237 - protein, 754 aa, Streptococcus agalactiae 2603V/R
MTRNFTTYVGQQGKVLSELTNEEIYVELLNFVKEEAAAKSKNSSQRKVYYISAEFLIGKLLSNNLINLGIYKDVKKELELVGKSIAEIEDVEPEPSLGNGGLGRLASCFIDSISSLGINGEGVGLNYHCGLFKQVFRNNQQEAEANYWIENNSWLVPTDISYDVPFRDFTLKSRLDRIDVLGYKKDTKNYLNLFDIDGLDYNLIEKGITFDKTEIKKNLTLFLYPDDSDKNGELLRIYQQYFMVSNAAQLLIDEAIERGSNLHDLAEYAYVQINDTHPSMVIPELIRLLTEKHGFEFDEAVSVVRNMVGYTNHTILAEALEKWPLEYLNEVVPHLVTIIKKLDQMIREEQTNPEVQIIDEAGRVHMAHMDIHFSTSVNGVAALHTEILKNSELKVFYDIYPDKFNNKTNGITFRRWLEFANQDLADYLKELIGDSYLTDATQLEKLLTYADSNEVHDKLAAIKFKNKLALKRYLKENKGIELDEYSIIDTQIKRFHEYKRQQMNALYVIHKYLEIKRGHFPSRKLTVIFGGKAAPAYTIAQDIIHLILCLSELINNDPEVNKYLNVHLVENYNVTVAEKLIPATDISEQISLASKEASGTGNMKFMLNGALTLGTMDGANVEIAELAGKENIYTFGKDSDTIINLYETSGYRSKDYYDKDKVIREAVDFIISDDIVSLGNAERLKRLHDELVGKDWFMTLIDLKEYIAVKEQVLADYEDYESWNKKVIHNIAKAGFFSSDRTIEQYNQDIWHSN

SEQ ID NO: 19238 - protein, 62 aa, Glycine max
ISDCNGACAARCRLSSRPRLCKRACGTCCRRCNCVPPGTAGNQEVCPCYASLTTHGGKRKCP

SEQ ID NO: 19239 - protein, 510 aa, Hordeum vulgare
MFIESFRVESPKVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESMCPLPGIYDPDFIAANQGSRANNVIKGTKKEQMEQVIKDIREFKEKNKVDKVVVLWTANTERYSNVSVGLNDTTENLLASVDKNEAEISPSTLYAIACVMEGVPFINGSPQNTFVPGLIDLAIKNDCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLRAPIILDLVLLAELSTRIQLKAEGEDKLHSFHPVATILSYLTKAPLVPPGTPVVNALAKQRAMLENIMRACVGLAPENNMILEYK

SEQ ID NO: 19240 - protein, 353 aa, Agrobacterium rhizogenes
MSDPFYLMYPQWALLPVVILATAATIIASQAVITGAFSMVRQGINLGFLPRREILFTSETNTGQIFVPSVNAVLFIGVIFLVLSFKTSDALATAYGISVTGAMVVTSIMAFEFVRARWNWSLPVAVIALAPLVILELIFLGANLLKIHDGGYIPILIATAFTVIMWTWRRGTAILMEKTRHTDIPLASFVSSIERKSEHSPAQVPGTAIFLTSDPESAPAALLHNLKHNHVLHDRNVILTIRTVNKPRVPSQDRYKVEQISERFSRVELLFGFMESQNVSQALATLRKAGLKFDIMSTSFYLGRRKLVPDANSGMPYWQDRFYILLANAASLPSDYFHLPANRVVELGSQIIV

SEQ ID NO: 19241 - protein, 187 aa, Bradyrhizobium japonicum USDA 110
MFNIARYFHKLSEATEVIRNDAISISELVGLNPRAVVISPGPCTPTEAGISTAVVRELSGRVPILGICLGHQCIASVFGGRVARARRPMHGRRSYVAHDGRGLFKGLPTPLDVGRYHSLIVALDQSCAQNLVVTARSEEGEIMALTHGYYPTYGVQFHPESILTSQGHVLLKNFLRLAQDFRNRAEQ

SEQ ID NO: 19242 - protein, 352 aa, Cryptococcus neoformans var. grubii
MGCTQSTEDVAAKARSAEIDEQLKRDRANLRNEIKMLLLGAGESGKSTVLKQMRLIYNKPYDAEERDSYREIVYSNTVQSMRVLLEGVQFMDIPIDTSNQSRWELIMAAPPQIEGDVFPSKLTDAVAGLWKDYGVQQAFFRRNELQLNDSAPYYFDAIARIAQPNYMPTDQDILRARVKTTGITETHFKIGELTYKLFDVGGQRSERRKWLNIFDSVTALVFLIAISEYDQKLYEDESVNRMQEAMTLFESVANSRWFTKTSIILFLNKIDIFREKLPVSPLSNTFPEFRGGNDYDMACAFLLEKFVGLNNSPSKSIYAHYTDATDTKALKFVISAINDVIIQVNLRDCGLL

SEQ ID NO: 19243 - protein, 542 aa, Escherichia coli O157:H7 EDL933
MIAVEKLLPTGEDFASHVYPCYTSHRKETIMTNNPPSAQIKPGEYGFPLKLKNRYDNFIGGEWVAPADGEYYQNLTPVTGQLLCEVASSGKRDIDLALDAAHKVKDKWAHTSVQDRAAILFKIADRMEQNLELLATAEAWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 19244 - protein, 206 aa, Triticum aestivum
PPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPSGGAFKDMIMEGDGRT

SEQ ID NO: 19245 - protein, 357 aa, Photobacterium profundum
MLLTIDVNYSRIVSGYSHFLFFDMNRLQTATTDSNLMANPPTVKQNKIAIIGECMIELSGKPFASQAQNFGGDTLNTAVYLSRLLPSLRPSYVTAVGADTYSKIMLSAWESEGVDTSLTLVNPDKLPGMYAIEIDDDGERSFHYWRDDSAARYLCEHEGFNDVVSSLKSVDLVYLSGISLAILSDHGKVKLLNTLAQLKSSGVKIAVDSNYRPRLWRNATDACEWLGKLYQLSDIALVTADDEELLLGRKLSEPQVIARRLHSLGIKQVVVKLGSDGAMWSQAGNQGVVSGNKVTQVIDTTAAGDSFNAAYLAAWCSGMEMAECCYWGNKLAAQVIQHKGAIIPVEQTRYITELMSD

SEQ ID NO: 19246 - protein, 161 aa, Oryza sativa; identical to SEQ ID NO: 4643

SEQ ID NO: 19247 - protein, 480 aa, Microbulbifer degradans 2-40
MSKCPYQTTSAGSPVADNQNSQTAGPRGPVLMQDYQLLEKLAHQNRERIPERVVHAKGWGAFGTFTVTKDISKYTRAKIFDTVGKQTPLLTRFSTVAGELGAADAERDVRGFAVKFYTEEGNWDLVGNNTPVFFIRDPLKFPDFIHTQKRHPKTNLRSPTAMWDFWSQSPESLHQITILMSDRGLPTDVRHINGYGSHTFSFWNNDGERFWVKFHFKTQQGHRHWTNEEAEKVVGKTRESTQEDLFSAIENGNYPKWTVNVQIMPEADAEKTSYNPFDLTKVWPHSEYPLIEVGEMELNRNAENYFAEIEQAAFSPSNVVPGIGFSPDKVLQARIFSYADAHRYRIGTHYEALPVNAPKCPVHHYHKDGSMNFFGNKSGSTDAYYEPNSFGGAVQNPDVAEPPLKISGDADRYNHREGNDDFSQPAALFNLFDDGQKQRLFNNIAGAMQGVPQNIIDKQLALFDKVDPAYGAGIRAALKA

SEQ ID NO: 19248 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSLNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 19249 - protein, 735 aa, Oryza sativa
MSLAAESPSPSSPSSSSGSDDFAALLDAELELTSAADSASAGDPSAATDDDDEGGDEEEEDVVVVVEQEDAIVEQSRYAPLRTLTSSRGARSRSSWVWRRLEALGGSVLLALSVLDGSSKDVKIDECPPHPGFFGGLCYRCGKRQDEEDVPGVAFGYIHKGLRLGTTEIDRLRGADLKNLLRERKLVLILDLDHTLINSTKLFDLSAAENELGIQSAAKEETCLNAVVPDRSLFTLETMQMLTKLRPFVRRFLKEASDMFEMYIYTMGDKAYAIEIAKLLDPDNVYFGSKVISNSDCTQRHQKGLDVVLGDESVAVILDDTEYVWQKHKENLILMERYHYFASSCRQFGFGARSLSETMQDERENDGALATILDVLERIHTIFFDPDDQKPLSSRDVRQVIKRVRQEVLQGCKLVFTRVFPLHQRQQDQMIWKMAEQLGAVCCTDVDSTVTHVVALDLGTEKARWAVSNKKFLVHPRWIEAANFRWQRQQEEDFPVARPKEKGKENAADAPISKENGDKNAADAANAKKGNENVADAAQRRGVKKMLMMLLTQRRSKENADDAANAEKSKSDGAASGATGSPVCLIVKALRKRCKASLVREFCDGDIKHAQSYPHCCQRRLHESRFPCSVRDRNHHRHYPELWQEFISTCNISRLVTTSSVHVIWHRAGRRTKATNAAENHNSTSPNSILVVLGARDDVARAARAAGRLRLRVGGVVDRSVVRARSGEPSRVGGS

SEQ ID NO: 19250 - protein, 486 aa, Shewanella oneidensis MR-1
MSQQYLTSQSGSPIADDQNSLSAGERGPLLLQDWHLIEKLAHFNRERIPERVVHAKGTGVYGTFTLTKDLSDYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLSNEQADKLKGIDPDSSQRDMVVAITDGNFPRWTVNVQIMPEADANTYHINPFDLTKVWPHGDYPLIEIGVLELNRLPQNYFAEVEQVALAPSNLVPGVGASPDKMLQARLFAYADAQRYRIGANYNQLPVNCPHAAKANHHQRAGAMAGTQCPYHGSQTGGDASANYGPNSTIGALVEPANFAEPPLRLDGETARYSRYNQDDYTQAGNLYRIFSEEEKARLVATISGSLRQASMDVQQRMLAHFQKADADYGQRIKMALGL

SEQ ID NO: 19251 - protein, 469 aa, Xanthomonas axonopodis pv. citri str. 306
MSVENVEKLIKDNKVEFVDLRFVDMRGVQQHITFPVNIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 19252 - protein, 578 aa, Ferroplasma acidarmanus
MDIFLISFSGMVGSGWLLGVLAGPAYAGPASILTWVVAGVFFIILALVFSELGTLFPYSGSLVRFNEFSHGPVSNFYLGWAYMIGAIATPPVEAAALTGFISSYVPGIYNSSVALLTPLGVIVALALLGLFIIVQYAGVNVFGKSNAVMTWFKMAAIILTIIFVFAFIFHARNFFALSHGFLPYGPSSVFAAMVPAGVIFSYEGFRQGLDYAGETKNPKRSVPLGMISAMLAAMATYIMLQIVFIGAVNWKAAGVPVGDWSGLLSSTWSANPFFYAFHSTDETLLIGFSIFLIIVAVVSSASTLGVYVGSSARSLYGMAKMNYIPAFFGKIHPRFRTPWISLVVTFIIGAMFLLPFPSWYALVGINSSFTVFAYLAAGITNTSLRKTAPEMERPFKTPFLTVMAPLAFVIASMLVYFSGWSTVALLLLIVDGGLPIFLLSRYGRETFHINMRSASLFSAIYWVIFIFIGIIYALSLLPFEEYFALFSATILVTPYLLYRMSGRTASIHIRASIWIVVYSIILGIMSYYGSLGINAIPFPYDYIIMAIMSLTIYFIAINTGYHTDKLKEYQSTGGVTDE

SEQ ID NO: 19253 - protein, 296 aa, Pseudomonas aeruginosa PAO1
MPARRLPLLLFGAFFALYFIWGSTYLAIRFGVESWPPMLMAGVRFVIAGGLMFAWLRWRGAPLPTWREWRGAGVVGILLLSCGNGGVTVAEHWGVSSGVAALAVATVPLFTLLFSQLFGQRNTTLEWGGIVLGLFGIVLLNLGSNLQASPAGAGLILFAAASWAFGSVWSRRLSLPAGPMASAAEMLVGGAVLLVGSLASGERLEHWPSTSGWLALVYLILFGSIIAFSAYQYLLRNVRPAAATSYAYVNPAVAVLLGTLFAGERIGGIEGLAMLVIISAVVLIGLPQWRASRAAA

SEQ ID NO: 19254 - protein, 363 aa, Oryza sativa; identical to SEQ ID NO: 8651

SEQ ID NO: 19255 - protein, 335 aa, Saccharomyces bayanus
MSEPAQKKQKVANNSLEQLKAAGTVVVADTGDFNSIAKFQPQDSTTNPSLILAAAKQPAHAKLIDVAVAYGKKHGKTTAEQVESAVDRLLVEFGKEILKIVPGRVSTEVDARLSFDTQATIDKARHIIKLYEQEGVSRERVLIKIASTWEGIQAAKELEEKDGIHCNLTLLFSFGQAVACAEAQVTLISPFVGRILDWYKASTGKEYAGETDPGVVSVKSIYNYYKKYGYKTIVMGASFRSTDEIKNLAGVDYLTISPQLLDTLMNSTEPFPRVLDPATAKKEAGDKISYINDEPKFRFDLNEDAMATEKLSEGIRKFSADIVTLFDLIEKKVTA

SEQ ID NO: 19256 - protein, 62 aa, Glycine max
  unsure (1)..(62): unsure at all Xaa locations
MKVKILQWHAVASWTWDAQDETCGICRMAFDGCCPDCKFPGDECPIIWGACXNHAFHLHCIL

SEQ ID NO: 19257 - protein, 360 aa, Pseudomonas aeruginosa
MSKQILVLPGDGIGPEIMAEAVKVLELANDRFQLGFELAEDVIGGAAIDKHGVPLADQTLQRARQADAVLLGAVGGPKWDRIERDIRPERGLLKFRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 19258 - protein, 328 aa, Neisseria meningitidis
MAKCIERQLSFGTFRYWKIVFRRHPDAMPSENPSQRKKEKMKGIILAGGSGTRLYPITRGVSKQLLPVYDKPMIYYPLSVLMLAGIRDILVITAPEDNASFKRLLGDGSDLGISISYAVQPSPDGLAQAFIIGEEFIGNDNVCLVLGDNIFYGQSFTQTLKQAARQTHGATVFAYQVKNPERFGVVEFNENFRAVSIEEKPQRPKSDWAVTGLYFYDNRAVEFAKQIKPSARGELEITDLNRMYLEDGSLSVQILGRGFAWLDTGTHESLHEAASFVQTVQNIQDLQIACLEEIAWRNGWLEKKDVETRAKPLEKTAYGQYLLHLIGK

SEQ ID NO: 19259 - protein, 486 aa, Bradyrhizobium japonicum USDA 110
MNAHTGTVRGKERYRSGVMEYKRMGYWEPDYTPKDTDVIALFRVTPQEGVDPIEASAAVAGESSTATWTVVWTDRLTAAEKYRAKCYRVDPVPGTPGSYFAYIAYDLDLFEPGSIANLSASIIGNVFGFKPLKALRLEDMRFPVAYVKTFQGPATGIVVERERLDKFGRPLLGATVKPKLGLSGRNYGRVVYEALKGGLDFTKDDENINSQPFMHWRDRFLYCIEAVNRAQAASGEVKGTYLNITAGTMEDMYERAEFAKELGSCIVMIDLVIGYTAIQSMAKWARRNDMILHLHRAGHSTYTRQKSHGVSFRVIAKWMRLAGVDHIHAGTVVGKLEGDPNTTRGYYDVCREDFNPTKLEHGLFFDQSWASLNKMMPVASGGIHAGQMHQLLDLLGEDVVLQFGGGTIGHPMGIAAGAIANRVALEAMILARNEGRDYVHEGPEILAKAAQTCTPLKSALEVWKDVTFNYQSTDTPDFVPTALETV

SEQ ID NO: 19260 - protein, 488 aa, Elachista fucicola
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVRGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 19261 - protein, 371 aa, Cryptococcus neoformans var. grubii
MPLESCMLILDNSEYMRNGDYPPTRFQAQAEAVQTVFTAKTDANPESAVGMMTMAGNSPSLLVTPTNDLGRLMHALSKVLISNTAQLSTAISIAQLALKHRENKNQRQRIVIFVGSPLGESAESLVKLGKRLRKNNVFVDIVTFGDEGRDNDEKLRGLVEAVGDESNLVSVPPGERFLSDVIASSPILFDGENPMAAAGGFEGDIDPNMDPELAMAIRMSLQEAQAQQSQSADAGPSSGAGVALPDSLTQPLSTTHPSSSSGDVLMAPGDKGNLPGTPNAQAHAEAADKAGAIAESGTGSTFISGNPLTGNRAPDVAQQEEEDEELKRALAMSRGEGGDIEMEEEEDEEAAIARAIAMSLEGQEEGKDKNH

SEQ ID NO: 19262 - protein, 330 aa, Yersinia pestis KIM
MPKVHAQTMRNDNMTDKLTSLRQITTVVADTGDIAAMKLYQPQDATTNPSIILNAAQIPEYRKLIDEAIAWAREQSSDHAQQIVDATDKLAVNIGLEILKLIPGRISTEVDARLSYDTVASVAKAKRLIKLYNEAGISNDRILIKLASTWQGIRAAEQLEKEGINCNLTLLFSFAQARACAEAGVFLISPFVGRILDWYKANGDQKEFAPSEDPGVVSVTEIYQYYKKHGYKTVVMGASFRNLGEIIELAGCDRLTIAPSLLKELAESEGPVERKLAYTGEIQAKPAPLTEAEFYWQHNQDPMAVDKLADGIRKFAIDQGKLEKMISDLL

SEQ ID NO: 19263 - protein, 326 aa, Mycobacterium tuberculosis H37Rv
MGANHVRNDPIMARLTVITTGGTISTTAGPDGVLRPTHCGATLIAGLDMDSDIEVVDLMALDSSKLTPADWDRIGAAVQEAFRGGADGVVITHGTDTLEETALWLDLTYAGSRPVVLTGAMLSADAPGADGPANLRDALAVAADPAARDLGVLVSFGGRVLQPLGLHKVANPDLCGFAGESLGFTSGGVRLTRTKTRPYLGDLGAAVAPRVDIVAVYPGSDAVAMDACVAAGARAVVLEALGSGNAGAAVIEGVRRHCRDGSDPVVIAVSTRVAGARVGAGYGPGHDLVEAGAVMVPRLPPSQARVLLMAALAANSPVADVIDRWG

SEQ ID NO: 19264 - protein, 319 aa, Staphylococcus aureus subsp. aureus Mu50
MRRLFSIGEALIDFIPNVTNANLKDVQTFTKQIGGAPCNVSCTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 19265 - protein, 365 aa, Pseudomonas aeruginosa PAO1
MVHNRIDPPFTRYLDSDGRPLGELPAWAGDSDALVGLYRQMLLTRLFDQKAVALQRTGRIGTYAPTLGQEAIGVAIGSQMRAEDVLVPYYRDTAVQLMRGVRMEDILLYWGGDERGSDYAEPLAAQDFPICVPIATQALHACGVASAFRIRGEHRVAVTTCGDGATSKGDFLEALNVAGAWQLPVLFVVNNNQWAISVPRRIQCGAPTLAEKAVGAGFPGEQVDGNDVLAVAERVRAALERARQGKGPTLLECISYRLCDHTTADDASRYRSAEEVNQAWREEPIKRLRAFLAGRGQWDEEREQALVGECQARVQEAVERFETFAAQAPQALFEHVYARWPAVLEEQREQLLERAARRRGGAEHE

SEQ ID NO: 19266 - protein, 357 aa, Xylella fastidiosa Dixon
MSKQILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGYIKTADAIEYAVGVVLDSGLRTADIWSEGMTKVGTVAMGDAVVAAL

SEQ ID NO: 19267 - protein, 349 aa, Escherichia coli O157:H7 EDL933
MKIKAVGSYSAKQPLEPMDITRREPGPNDVKIEIAYCGVCHSDLHQVRSEWAGTVYPCVPGHEIVGRVVAVGDQVEKHAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 19268 - protein, 316 aa, Pisum sativum
MWPFSSKKGVSGFSGSSTAEQVTHGIDATGLTAIVTGASSGIGAETTRVLALRGAHVIMGVRNMVAAKDVKDTILKDIPSAKVDAIELDLSSLDSVKKFASEFNSSGRPLNILINNAGIMACPFKLSKDNIELQFATNHIGHFLLTNLLLDTMKKTTRESKKEGRIVNVASEAHRFAYPEGIRFDKINDQSSYNNWRAYGQSKLANVLHANQLTKHLKEDGVNITANSLHPGTIVTNLFRHNSAVNGLINVIGKLVLKNVQQGAATTCYVALHPQVKGVSGEYFSDSNVYKTTPHGKDVDLAKKLWDFSINLVKQK

SEQ ID NO: 19269 - protein, 457 aa, Choristocarpus tenellus
  unsure (1)..(457): unsure at all Xaa locations
DYNVKDTDILALFRITPQPGVDPVEAAAAVAGESSTATWTVVWTDLLTACDIYRAKAYRVDPVPNTANQFFAYVAYECDLFEEGSLANLTASIIGNVFGFKAISALRLEDMRIPFAYLKTFQGPATGLIVERERLDKFGRPLLGATVKPKLGLSGKNYGRVVYEGLRGGLDFLKDDENINSQPFMRWKERFLYCMEGVNRAAAGTGEVKGSYLNVTAGTMENMYZRAXYXKQIGTVIIMIDLVIGYXAIQSMAVYARKAQLILHLHRAGTSTYARQKNHGINFRCICKWMRMCGVDHIHAGTVVGKLEGDPLMVKGFYNTLLLTSLEIDLAQGIFFDMDWASLRKCVPVASGGIHCGQMHQLLYYLGDDVVLQFGGGTIGHPDGIQAGATANRVVLESMVLARNEGVDYVEQGPEILRNAARVCGPLKAALDLWKDITFEYTSTDTPDFIETATEAK

SEQ ID NO: 19270 - protein, 99 aa, Ficus carica
DEMDFEFLGNLSGDPYTLHTNVFSQGKGNREQQFHLWFDPTKAFHTYSVVWNKQRIIFLVDNIPIRVFNNLESAAGVPYPKSQPMRIYSSLRDATWATR

SEQ ID NO: 19271 - protein, 575 aa, Schizosaccharomyces pombe
MVQSPTSYHACSNNQSPFPHSHHPPLHNPLPVSCQPVLRPPPVPQVPSHWYPVSLPSPNLPHQPISKPPVIPNLPKLQVHPNRLPHPIHNHPYSSPTSYPPPLCPATYCPSNPPQLAPATAIAPSSQSSQHKSVNYSVTPSSINNHTAVPLSPTLAVWLPMTQPTFQPPSANVYQPASNANQVITPVSISDYRPPKKRKRAAWPPYKKVDRVNVPVVHDTTAFDPSTFDDDDGHYKVVPNSKFANRYTVVRLLGHGTFGKVIQCYDQSTGRHCAIKVTRAIPKYREASLIELRVLQTIAHSDPTNENKCIQLRDYFDYRKHICIVTDLFGWSVFDFLKNNNYIPFPLKHIQMLSQQLFKSVAFLHSLGLVHTDLKPENVLLVSNASRTIRLPYRNYSQKVLNSCEIRLIDFGSATFEDEYHSSVVSTRHYRAPEIILGLGWSYPCDVWSIGCILVELFTGQALFQTHEDSEHLCMMEKILGPFDRNMISRSSRTSQRFFKSDGKVRYPLSNTPKKSINYLQSLQTLEQIFAVSSPEVALLLDLLKKVFVYDPKRRITAKEALWHPFFTQPISSNL

SEQ ID NO: 19272 - protein, 274 aa, Arabidopsis thaliana
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 19273 - protein, 297 aa, Streptococcus pneumoniae R6
MMRIKQMTENRYELNKNLAQMLKGGVIMDVQNPEQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDLQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 19274 - protein, 256 aa, Zea mays
MDPGAGAHYSARTAEEVFRDFRGRRAGMIKALTNDVEKFYQLCDPEKENLCLYGYPNETWEVTLPAEEVPPEIPEPALGINFARDGMNEKDWLALVAVHSDAWLLAVAFYFAARFGFDKEARRRLFNMINNLPTIFEVATGVAKKQNKEKEPNNTSKSNKPSSKMTTRPESHLKATKVAPPKDEDDESGEEYEEEEERDNTLCGSCGTNDGKDEFWICCDSCERWYHGKCVKITPARAEHIKHYKCPDCSNKRARA

SEQ ID NO: 19275 - protein, 279 aa, Zea mays
MAARLRRSPISSPIPPPSLCISLYPPPHSSVETTYPACSTYLRSPAMTVLDAESRFHVLAVDDSIIDRKLIEMLLKSSSYQVTTVESGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPNQKNKPQAQAVESPEQQLDPHPQPVHEPEEAAADRNGVNKRKAAAMEEGLTVVVTAPESTKPRRLSTSSLTVET

SEQ ID NO: 19276 - protein, 347 aa, Petunia x hybrida
MEGGGNSSGNNTSSLMAYGDHENNNNAICPPMMMMMMPPPPLSITNTSNNGESSSNNNNNILFLPFMENNSNTIHEDGNSCSSNIKAKIMAHPHYPRLLAAYINCQKIGAPPEVVARLEEVCATSAHMGRNGGGGGGGGNNVIGEDPALDQFMEAYCEMLTKYEQELSKPFKEAMVFLSRIECQFKALTLASTSESVAAFGEAMDRNGSSEEEVDVNNSLVDPQAEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYIDNVLGNPFPMDMTPTLL

SEQ ID NO: 19277 - protein, 188 aa, Zea mays
AICVHHQGLGLGKPMEEMLMAGNANLNQNPNPPPAAPSAPGAQRAGAPAAVAAAPPSAGATGGAGPERRARPQKEKALNCPRCNSTNTKFCYYNNYSLQQPRYFCKTCRRYWTEGGSLRNVPVGGGSRKNKRSSSAVSSAAAAAAASTSAAMSGTVPVGLAAKNPKLMHEGAHDLNLAFPHHNGRALQ

SEQ ID NO: 19278 - protein, 146 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 19279 - protein, 297 aa, Zea mays
RLVAGNPSFVSGGGMAGGPGWEREKAAIAAHPLYERLLEAHVACLRVATPVDQLPRIDAQIAARPPPMEAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNSASSSSDKSKRKRNTAGDGNAEPAW

SEQ ID NO: 19280 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 19281 - protein, 459 aa, Staphylococcus epidermidis ATCC 12228
MADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 19282 - protein, 199 aa, Nitrosomonas europaea ATCC 19718
MLLMIDNYDSFTYNLVQYLGELGEEVMVVRNDEITLEAVQQLNPASVVISPGPCTPDEAGISVELINRFSGKIPILGVCLGHQSIGQAFGGRIVRAGKVMHGKTSLVFHDGKGVFQGMPDPFVATRYHSLVIERSSIPDCLEISAWTEDGEIMGVRHRALPVEGVQFHPESVLSEHGHLLLDNFLHGNSVQKHSSMCEA

SEQ ID NO: 19283 - protein, 126 aa, Glycine max
MVLEATMICIDNSEWMRNGDYSPSRFQAQTDAVNLICGAKTQSNPENTVGVLTMAGKGVRVLVTPTSDLGKILACMHGLEIGGEMNLAAGIQVAQLALKHRQNKKQQQRIIVFAGGPVKHEKKMLE

SEQ ID NO: 19284 - protein, 145 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 19285 - protein, 356 aa, Nostoc punctiforme
MAAENIKMAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 19286 - protein, 463 aa, Streptococcus pyogenes MGAS8232
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPILAIIICLSFMSQYKAFTWIAFAIATIIGTLIYLAYGYTHSIENK

SEQ ID NO: 19287 - protein, 653 aa, Neurospora crassa
MDAKPQRPLWAPPVRYGDENIPPADPTHQSKRSDSKIKAMMAVNGTLNAPPKRAACFDKSNTSKPLADGGNKDMLKNRVKPMVTTSSTRDLRSDGRENNRSAAEEHYMRPTATSKAASHGHQKYSSTAPLSSHAASGAYGGIRSHNAIAKLSAPVKKTTNVYRDNKVKEESTSHAPTSSSVDDLVAMVDKHIKDPRHYKSQPQLKSDQQHTLHRNQSKYVPNYENLNDVDDPDDSNADYAESYEDAVEQLSRDLDIPANTDPAAIVHANHMSIAQASYDSMPQGAPLAPSKPVRALPLPPNVSDPEEYSEDDDDQDLYDDQGYTTAHSYRSHCDNTTGGPPTLVAPKFTADIQKELDIAKAWVLEHQTEEEVEEENWDVSMVAEYGDEIFEYLRELEERMLPNPHYMDIQTEIRWSMRSVLMDWLVQVHHRFSLLPETLFLTVNYIDRFLSVKVVSLGKLQLVGATAIFVAAKYEEINCPSIQELVYMVDQGYSVEEILKAEKFMLTMLNFELGWPGPMSFLRRISKADDYDLETRTLAKYLLEVTIMDERFVGCPASYLAAGAHCLSRFFLQRGPWTHAHVHFSGYTLAQLRPLIISILDCCQEPRKHHGAVYDKYSHQRFKSASTFVEGKIANGFVLPIRTNASISDSAQS

SEQ ID NO: 19288 - protein, 470 aa, Gelidium pulchellum
  unsure (1)..(470): unsure at all Xaa locations
GVIPYAKMGYWDPDYAVKETDVXALFRVTPQPGVDPVEASAAVAGESSTATWTVVWTDLLTACDLYRAKAYKVEEVPNSSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 19289 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 19290 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 19291 - protein, 477 aa, Mycobacterium tuberculosis
TEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 19292 - protein, 474 aa, Escherichia coli CFT073
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 19293 - protein, 357 aa, Synechococcus sp. PCC 7942
MTRPNHGGNLRWAAGLAGASPADLLDFSASLNPLGPPAWLATWLQQHYTHLIAYPDPQYRQLREAIARHHDCDPDWILPGNGAAELLTWAARDLAACREVLLLGPAFRDYERALTAVGVPWRRLALPLDRPASLATLRGLLEPQLTPETGLLINNPHNPTGWLWPLRDLWPLLQRCRLVVADEAFLDFLPTAADWSLQPCLAQSRSLVIVRSLTKFYSLAGLRLGYAIAHPDRLESWQQWRDPWSVNGLAAALGPELLADHDFQAATWNWLPPARAALASGLASIPGLRVLPSQANFLLVQAEDSILPLQERLLQQHRLLIRDCLSFTELGDRWFRVAVRSSAENQRLLEAIAAELA

SEQ ID NO: 19294 - protein, 186 aa, Populus x canescens
DPELDQFMGAYYDMLVKYREELTRPIQEAMDFMRRIETQLNMICHGPLRIFNSDDKSEGVGSSEDDQDNSGGETELPEIDPRAEDRELKNHLLRKYSGYLGSLKQELSKKKKKGKLPKEARQKLLSWWELHYKWPYPSETEKVALAETTGLDQKQINNWFINQRKRHWKPSEDMQFMVMDGLHPQN

SEQ ID NO: 19295 - protein, 496 aa, Lycopersicon esculentum
  unsure (1)..(496): unsure at all Xaa locations
MKKATVGAVVVGTAAAVAVAALVMRHRMGKSSKWARARAILKEFEEKCATPDAKLKQVADAMTVEMHAGLASEGGSKLKMLISYVDNLPTGDEAGVFYALDLGGTNFRVLRVQLGGKDGGIMHQEFAEASIPPNLMVGTSEALFDYIAAELAKFVDEEGEKFHPPPGKQRELGFTFSFPIMQTSINSGTLIRWTKGFSIDDTVGKDVVAELTKAMQKREIDMRVSALVNDTVGTLAGGRFTDKDVSIAVILGTGTNAAYVERAQAIPKWHGPLPNSGEMVINMEWGNFRSSHLPLTQYDNAMDTDSLNPGEQIFEKICSGMYLGEILRRVLLRMAKEAGIFGEEVPPKLKNSFILRTPEMSAMHHDTSSDLRVVGDKLKDILEISNTSLKTRRLVVEXCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 19296 - protein, 442 aa, Zea mays
MASRNHNAAAPQLHHHNRAGVPALGKTKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEYIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 19297 - protein, 687 aa, Sinorhizobium meliloti
MAKKPSAPNNTKPATIHDQKATRGNGGELHQIAEGDTPVLTTAQGGPVADDQNSLRAGERGPTLIEDFHFREKIFHFDHERIPERVVHARGYGVHGFFETYESLAAYTRADLCQHPGERTPAFVRFSTVAGSKGSFDLARHVRGFAVKIYTKEGNWDLVGNNIPVFFIQDAIKFPDVIHSVKPEPHREFPQAQSAHDNFWDFISLTPESMHMIMWVMSDRGIPRSFRFMEGFGVHTFRFVNAKDESTFVKFHWKPKLGLQSLVWNEAVKINGRDPDFHRRDMWQAIQSGNFPEWDLHVQLFDQDFADKFDFDILDPTKVIPEEVLPTKPVGRLVLDRMPENFFAETEQVAFMTQNVPPGIDFSDDPLLQGRNFSYLDTQLKRLGSPNFTHLPINAPKCPFQHFQQDGHMAMRNPVGRVNYQPNSWSEGPKLRIRAESFADHYSQARQFFISQTPPEQRHIADALTFELSKVETPVIRERMVAHLLNIDETLGKKVGHALGLETMPKPADAAVATRQDLDPSPALSIIQRGPKRFEGRKLGILATDGADGALLDALIGAVENEKAAFELIAPKVGGFTASDGKRIAAHQMLDGGPSVLYDAVVLLPSAEAVADLIDVATARDFVADAFAHCKYIGYAGAAVPLLERAGIAELLDEGTIELTDAASAAAFLTEIGKLRVWGREPSVKLK

SEQ ID NO: 19298 - protein, 56 aa, Zea mays
FFLPGFSHLMKQPKILLLIFVSGKIVLTRAKVRDELHIAFEIIYPVLIKIIKVRQC

SEQ ID NO: 19299 - protein, 325 aa, Geobacter metallireducens
MESKLRALLPDAELIRMYEQMVLSREFEESCAEQYTKGHITGFLHLYSGQEAVAVGATAGLHRDDYILSAYREHAQAIVRGAEPRRVMAELFGKRTGICKGKGGSMHLFDPNLSFMGGYAIVGGQFPIAVGLAFAAKFRKEGRIVACFFGDGAANQGTFHESLNWARLWELPVLFICENNSYGIGTSVERASALPDIHRRTCGYDIPSERVHGMDVIAVYEAVKWAAEWVREQNRPFLIEAITYRFRGHSMSDPGKYRSLAEVELWKSRDPIPAFANRLVEEEIATEAQLEGIKQQALVTVADAVKFAEDSPWPEDSEVWEDVYA

SEQ ID NO: 19300 - protein, 99 aa, Zea mays
SIYSLKKKKKKKKKKKKKKKKAGIRGSTLIINMPGNPNAVAECLEALLPALKHALKQIKGDKREKHPRHTPHAAAAPVDQWERSFRAASSGSGGCSCDP

SEQ ID NO: 19301 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILXFXSQIPGVSFTEQEVADLTKRIQNAGTEVVEAKAGGGSATLSMGQAAARFGLSLVRXLQGEKGVVECAYVEGDGQYAR

SEQ ID NO: 19302 - protein, 507 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGLSTPVNLSVMFHSITNSIVARATFGKKRKNAAEFMAAIKSGVGLASGFNIPDLFPTLTTVLATITGMKRSLHGIHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASELRYLKLVIKEALRLHPPAPLLVPRESIDMCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 19303 - protein, 400 aa, Glycine max
  unsure (1)..(400): unsure at all Xaa locations
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTALGSVGSDRDAPKPLDIVSNEIILSSLRKSGRVAVMASEENEXPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 19304 - protein, 116 aa, Rickettsia rickettsii
MFNIEYSLWFEYILKGLSLLKLPTPLGGTSNYFKTDILNKLGGWDSYNVTEDAELGIRIYSQNYKVAIRDSYTLEEVPNSLGNWLNQRSNWIQGFVKHFWYLKHKKINAKSLLYCK

SEQ ID NO: 19305 - protein, 365 aa, Dianthus caryophyllus
MVAEKPKTLTSLEGDDKLNSNFVRDEDERPKVAYNEFSNDIPVISLAGIDGEKRGEICRKIVEACEDWGIFQVVDHGVGDDLIADMTRLAREFFALPAEEKLRFDMSGGKKGGFIVSSHLQGEVVQDWREIVTYFSYPTNSRDYTRWPDKPEGWIKVTEEYSNKLMTLACTLLGVLSEAMGLELEALTKACVDMDQKIVVNYYPKCPQPDLTLGLKRHTDPGTITLLLQDQVGGLQATRDGGKTWITVQPVPGAFVVNLGDHGHFLSNGRFKNADHQAVVNSECSRLSIATFQNPSPDATVYPLAIREGENSIMEEPITFADLYRRKMAKDLEIARHKRLAKEEMPFKELDEAKFESKSIDQILA

SEQ ID NO: 19306 - protein, 770 aa, Aspergillus awamori
MADSGLVDHSPHHPTKAAQLNTASNVILIDNYDSFTWNVYQYLVLEGATVNVFRNDQITLEELIAKKPTQLVISPGPGHPETDAGISSAAIQYFSGKIPIFGVCMGQQCIITCFGGKVDVTGEILHGKTSALKHDGKGAYEGLPDSLALTRYHSLAGTHATIPDCLEVSSSVQLTDDSNKDVIMGVRHKKLAVEGVQFHPESILTEYGRTMFRNFLKLTAGTWEGNGKHFDEQSNTTKATVSSNTAPKTDKKLSILERIYDHRRAAVAVQKTIPSQRPADLQAAYDLNLAPPQVPFPARLRQSPYPLSLMAEIKRASPSKGMIAENACAPAQARQYAKAGASVISVLTEPEWFKGSIDDLRAVRQSLEGLTNRPAILRKEFVFDEYQILEARLAGADTVLLIVKMLSVELLTRLYHYSRSLGMEPLVEVNTPEEMKIAVDLGAEVIGVNNRDLTSFEVDLGTTSRLMDQVPSSTIVCALSGISGPKDVEAYKKEGVKAILVGEALMRAADTAAFIAELLGGSSQNVSKESRSSPLVKICGTRSEEAARAAIEAGADLIGIIMVQGRTRCVPDDVALRISQVVKSIPKPAGQTPPTSRGTPAAASVEYFDHSARILRHPSRALLVGVFQNQPLDYILSQQQKLGLDVVQLHGSEPLEWAKLIPVPVIRKFGLDEPAIARRAYHSLPLLDSGVGGTGELLDQSRVQNVLDKDSGLRVILAGGLDPTNVAGIVQKLGESGRKVVGVDVSSGVESDGAQDLGKIRAFVQAVRGL

SEQ ID NO: 19307 - protein, 542 aa, Glycine max
  unsure (1)..(542): unsure at all Xaa locations
MAREQIQVLNALDVAKTQWYHFTAIIIAGMGFFTDAYDLFCISLVTKLLGRIYYHVDGAAKPGTLPPNVSAAVNGVAFCGTLSGQLFFGWLGDKMGRKKVYGMTLMLMVICSIGSGLSFGHRAKSVIATLCFFRFWLGFGIGGDYPLSATIMSEYSNKKTRGAFIAAVFAMQGFGILAGGIFAIIISVAFKERFDAPPYELDPAGSTVPQADYIWRIIRPXVMVGALPAALTYYWRMKMPETARYTALVAKNTKQAAADMSKVLQVEIQAEPQKEEQKANSYGLFSKEFLRRHGLHLLGTASTWFLLDIAFYSQNLFQKDIFSAIGWIPPAKTMNAIEEVYRIARAQTLIALCSTVPGYWFTVALIDKIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKADAGYPAGIGVKNALIVLGVVNILGFFFTFLVPEANGKSLEEMSGENDEDVGTQEESEQSHSQNNNRTVPYV

SEQ ID NO: 19308 - protein, 760 aa, Clostridium thermocellum ATCC 27405
MRRIEMAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFSEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIFMALENKKENAQYDKDAHHRLARQAAAESMVLLKNEDDVLPLKKSGTIALIGAFVKKPRYQGSGSSHITPTRLDDIYEEIKKAGGDKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGALADVLFGEVNPSGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 19309 - protein, 267 aa, Oryza sativa (japonica cultivar-group)
MGMARARARRLLPLLTFVTLGMILGSLLQLAFFRRIDDHSNVTHLENDQEAAFLRLGLVKPEVISWSPRIIVFHNFLSSEECDYLRSIARPRLQISTVVDVATGKGVKSNVRTSSGMFVSSEERKLPVIQSIEKRISVYSQIPEENGELIQVLRYEPSQYYRPHHDYFSDTFNIKRGGQRVATMLMYLTDGVEGGETHFPQAGDGECSCGGKMVKGLCVKPNKGDAVLFWSMGLDGETDSNSIHGGCPVLEGEKWSATKWMRQKEFV

SEQ ID NO: 19310 - protein, 305 aa, Sphagnum cuspidatum
GFGRIGRLVLRICLQHDDIEVVAVNDPFIDSKYMAYMFKYDSTHGIAKVDVHAVDDKTLQIGSKTVKVFGSRDPSEIPWGSAGADFIVESTGVFTTTAKAEAHFKGGAKKVIISAPSADAPMFVMGVNHESYKSGMNIVSNASCTTNCLAPLAKVVHDNFGIIEGLMTTVHATTATQKTVDGPSGKDWRGGRGASQNIIPSSTGAAKAVGKVLPELNGKLTGMSFRVPTPNVSVVDLTCRIEKGASYDEIKAAMKAASEGPMFGYLGYTEDDVVSTDFVGDSRSSIFDAKAGIALNLNFIKLVSW

SEQ ID NO: 19311 - protein, 508 aa, Haemophilus influenzae
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTDAEAAEIIANDRESHQRDLYEAIERGDFPKWTLFVQIMPEADAEKVPYHPFDLTKVWSKKDYPLIEVGEFELNRNPENFFADVEQSAFAPSNLVPGIGASPDRMLQARLFNYADAQRYRLGVCYRQIPVNRPRCPVHSNQRDGQGRVDGTYGSLPHYEPNSFSQWQQQPDFAEPPLRISGDAAHWDYRTDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 19312 - protein, 502 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQQQQQQQQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDAPYVPPIRGGQGDASQYDRYPEETEQYGQQGEDVHGHLFPDF

SEQ ID NO: 19313 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDEKAVPLTKQLMNDYEKTHASTIAVMPVPHEDVSSYGVIAPQDEGKDGLYSVETFVEKPAPEETPSDLAIIGRYLLTPEIFEILEKQAPGAGNEIQLTDAIDTLNKTQR

SEQ ID NO: 19314 - protein, 654 aa, Archaeoglobus fulgidus DSM 4304
MRKVFRDVVTVDEARGLLFNHFSPRRKTEVVPLHLAAGRVLAKDVYALTDVPPFDRATMDGYAVRAEDTFEAEEDSPVTLKVVGTVEAGKRPELEVESGKAVEIATGAMMPKGANAVVMVEFTRRREDEIDIFKPVSPGENVMYAGSDVMAGELIAREGTELTHREIGVMAACGISEVEVYCRPKVAIISTGNELVKPGERLGEGKIYDVNSYSIAAAVEENGGEAILMGIARDNEEEMRSIIAKALREADIVITSGSTSAGAGDVMYRILDDFHPGVIVHGIAIKPGKPAVIAVSDSKPIFGLPGYPTSAMTVFEVIVAPIIRELAGRRESSGAKVRARLAIKVFSAEGRREYLPVNVVEGAEGYSAYPVSGSYSGAVTAFAFTDGFVEIPENVVMLEEGDEVEVKLFSHLKPADLMIIGSHCIGVDILLSLMRKKKPYTSKVVNVGSTGGILAVKRGEADIAGTHLLDESGVYNEPIVRRYGVRDAVLVKGYLREQGLIVAKGNPKSITGFEDLLREDVTFINRNRGSGTRILTDMYLREVAERKGLSFNELTASIKGYSIEAKTHTSVAVAVASGKADVGVGIRSVASQYGLDFIPLRSEEYDFLIRKDRLEKKAVRDFLECLTSEEFAKELERVVGLRVYERTREVIEID

SEQ ID NO: 19315 - protein, 357 aa, Prochlorococcus marinus str. MIT 9313
MALVPLRLLLDHAAENGYGIPAFNVNNLEQVQSIMEAAYETDSPVILQASRGARSYAGEIFLRHLIIAAVETYPDIPVVMHQDHGNSPSTCFGAAANGFTSVMMDGSLEADAKTPASYEYNVAVTKEVVGVAHAIGVSVEGELGCLGSLETGMGEAEDGHGFEGKLDHSQLLTDPAEASDFVAKTKVDALAIAIGTSHGAYKFTRKPTGEVLAISRIAEIHKAIPNTHLVMHGSSSVPQEWLQMINKYGGAIPETYGVPVEEIQEGIRNGVRKVNIDTDNRLAFTAAVREASVADPANFDPRHFNKPARKYMKQVCLDRYQQFWCAGNASKIKQRDINYYSALYEKGQLDPKNAVAA

SEQ ID NO: 19316 - protein, 424 aa, Glycine max
MPLETFIIICSWHLMFQVDILLCTDCFHDGRFVTGHSSIDFIRVDSTTDFGDLDGDSWTDQETLLLLEAVEVYNENWNEIAEHVGTKSKAQCILHFLRLPVEDGKLENINVSSLSLSSIVKNQEDNGRLHCCSNGDSAGPVHNSQDSDGRLPFANSGNPVMALVAFLASAVGPRVAATCAHAALAALSRNNSGSTSHIEAPDNDNRTNSESVHNRDGGHDGEVANSNQKNEDKSKVLGSCGQNEGGSTLLSAEKIKDAAKEGLSAAAMKAKLFADHEEREIQRLCANIVNNKLKRLELKLKQFAEIETQLMRECEQVEKVKQRLASDRSHIVSTRLGNGGTTPPMNVAGAGPSMVNNNSNGRQQMISASSSQPSISGYGNSQPVHPHMSFVPRPSMFGLGQRLPLSYDSTTTFSFFRSDVQWPR

SEQ ID NO: 19317 - protein, 67 aa, Oryza sativa
  unsure (1)..(67): unsure at all Xaa locations
FSRLQSFPQLKKLMNAYXPRQSVEMNAIAFPFNGRRLRGEQTPVELQMKNGGEINPLLPQIGGCLPP

SEQ ID NO: 19318 - protein, 610 aa, Heliobacillus mobilis
MGTRFLNEFGRLVHDKKETNLCQEVNSGGYAARKNLKYPTTDGKLPRVAYFCMEYGLHEELPIYAGGLGVLAGDYLKAAHDSGLPMVAIGILWNQDYTHQFIGEQGRPYDTYPNIRFDSVKDTGVTVQVRVRGADVVCKVHKVDSYGNVPLYLLDTNFPGSEHGWMTNRLYGGSGQDRVAAEIILGIGGIRALRALGIEVDLYHLNEGHATFCGFELIREKMTHYGMTFHQAWEDVRKELIFTTHTPVEAGNEVHGHDLLRLMEAYNGLTYEQVKDIGGDPFNMTVAALRLSHIANGVSKLHGQTACKMWSDVHNAACIISVTNGVHNRTWQDHSISDAFEHKGDLWEAHLNNKYRLVDYIERHRNVRLNPDNLIVGFARRAAPYKRSDLIFRTAEVIEPLLQERKLQLVFSGKAHPNDGIGKDIIQQLVRMSEKYGNSVVFLENYNMEVARYMVRGCDVWLNNPRRPLEASGTSGMKAAMNGVLNLSTVDGWVGEGLQHQVSGWLINPDIEAHLQEWEQDERDLRELYRVLLNEVIPTYYNNRNYWIQMMRASIDMARWQFSSHRMIREYFDLMYELTRDAQEMDLTSMPMHHPEMDRTESPFPSPYNQ

SEQ ID NO: 19319 - protein, 413 aa, Psilosiphon scoparium
  unsure (1)..(413): unsure at all Xaa locations
AIXGEXSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFXIEGVNRAQAGTGEIKGHYLNVTAGTMEEMYQRAEFAKELGSVICMIDLVIGYTAIQTMAVWARKTDMILHLHRAGNSTYSRQKIHGMNFRVICKWMRMAGVDHIHAGTVVGKLEGDPLMIXGFYNTLLLSHLDIBLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKNISFNY

SEQ ID NO: 19320 - protein, 370 aa, Zea mays
SLRHTCTGVAIDRRNAPPPPDAAAEKDESTQGLQLPEDIRWERLDKARFFVVGAGLFSAVSAALYPAVVLKTRLQVAPAAAAAESAALPLSAVAAATAILRQEGALAFYRGFATSLAGTIPARALYMGALEATRSAVGPAALSFGAAEPAASAAAGAVAGLAAAVAAQVVWTPVDVISQRLMVQGNPCPASRYHGGLDAFRKTVASDGLRGLYRGFGMSILTYAPSNAVWWATYSLSQKIIWSGIGCYLCDYGVGVQEIDLGDGDSLLQPGCKTVMVVQGVSAAMAGGASAFVTMPLDTIKTRMQVMDGDGEPITVGRTVRRLIKEGGLAACYRGLGPRWASMSLSATTMITTYEFLKRLSDKGQGSDLA

SEQ ID NO: 19321 - protein, 194 aa, Haemophilus somnus 2336
MATLLKIGLVSVSDRASQGVYQDQGIPELLEWLKSALCDPFEVESRLIPDEQTLIEKTLCELVDDCHCHLVLTTGGTGPVKRDVTPDATLAVADREMPGFGEQMRQVSLHFVPTAILSRQVGVIRRNSLILNLPGQPKAIKETLEGVKDEHGNVIVKGIFSAVPYCLQLIDGIYIDTDPNVIESFRPKSARRTL

SEQ ID NO: 19322 - protein, 512 aa, ASPERGILLUS NIDULANS FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 19323 - protein, 479 aa, Chlamydophila pneumoniae CWL029
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 19324 - protein, 564 aa, Saccharomyces kluyveri
MSEITLGRYLFERLNQVEVQTIFGLPGDFNLSLLDKIYEVPGMRWAGNANELNAAYAADGYARIKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNTVLELIKDAKNPVILADACASRHNVKSETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSQVGEVVKDYKPVAVPAKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLKPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQE
